United States Patent 11,098,302 (IDENTIFICATION OF POLYNUCLEOTIDES ASSOCIATED WITH A SAMPLE) - sequence listing, part 93

SEQ ID NO: 321328 - DNA, 679 bp, Homo sapiens
  misc_feature: GZ8MTXP01C5HH1.3.12.B01.1.454.CMB.2.raw
  modified_base (199)..(199): a, c, t, g, unknown or other
  misc_feature (199)..(199): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagacgcccaccctctcctgcgagggccagtcagtagtgttgacagactaacttggcctggtaccagcagcaaccgtggccaggcctcccgaggcctcctacatctatgatgacctactacccgaccgacggggcccctaacccgggtactaccccgacggtacccgtagggtttaccgacggttcggggacgtagggttcgggggtacgtaaggggaactaagggtacgttccaaccgttaccaccaacctacgtcgacgcgacgtcctacgcgtaacgtcgtaggtagttgtttagacttaaggtttacttacgtggtactagtactaacttaacaacttacgtcggtaccgtcgtccgttacgtacggtttcgggaacggggtacgggaaccggtaaggggacggtaagtaacttaaacggaaacgttacggttcgggtacgggtcctacggacccttacttaacgttcgtttaaccg

SEQ ID NO: 321329 - DNA, 625 bp, Homo sapiens
  misc_feature: GZ8MTXP01BXY68.3.12.B01.1.454.CMB.2.raw
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
  modified_base (422)..(422): a, c, t, g, unknown or other
  misc_feature (422)..(422): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcagggccagtcagagtgttgacagcaacttggcctggtaccagcagcaacctggccaggcctcccaggcctcctcatctangatgcactccaccgacgggcccacggtacnccccagcctaggttcaggtcggactaggtggggtcctaggggactggtacgttccaccttctccacctatcagcacgcctgcagtcgtgtagtntttgacttagtttattactggtctagtacttaattaactaaacttaccgtcggtacccgtcggtccttaccgttaccgggtttccggggaacggggtaacggggttaaccggtaaaggggttcgggaaacggtaacgttaaccggaaaacggttaacgtgggtacggtccgttcggacccttaccgtaacgtttccgtttccg

SEQ ID NO: 321330 - DNA, 614 bp, Homo sapiens
  misc_feature: GZ8MTXP01EEOEP.3.12.B01.1.454.CMB.2.raw
  modified_base (286)..(286): a, c, t, g, unknown or other
  misc_feature (286)..(286): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgcccaccctctcctgcagggccagtcagagtgtgacagcaacttggcctggtaccagcagcaactggccaggctccagctccnatctatgatgcatccaccgagggcccacggtactcccagcctaggttcaggtggcaggtgggtctaggggactggtactttccaccttctaccgaccatccacgcacgcctagccagtcgtaggtagttatttgacttagtttattacgttggtactagtactaattaactaaacttaacgtcggtaccgtcggtcctacgttaccggtttccggggaacgggtaacggggttaaccggtaaggggttacgggaaagtaacgttaacgaaaacggttaccgttaagggtcgggtaaccttcggacccgttacctaacgttccgtttcg

SEQ ID NO: 321331 - DNA, 587 bp, Homo sapiens
  misc_feature: GZ8MTXP01BHZHD.3.12.B01.1.454.CMB.2.raw
  modified_base (319)..(319): a, c, t, g, unknown or other
  misc_feature (319)..(319): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggctccaggctctcatctatgatgcatccacgaggcccacggtacncccagccaggttcacgtggctaggtgggtctaaggggactaaggacgtttaccaccgttctaccgacctataccacgcacggcctgcgtagtctaggtaggttattttgacttaaggtttacttacgtggtctaagtctaattaacaagtaacgtggacctcggtacctcgtacgttcgggcgggaacgggaccgtaagggttcgaagtaacttacgaaacggttaacgtggtacggcttcggaccttaccgtaacgttccgttaacg

SEQ ID NO: 321332 - DNA, 568 bp, Homo sapiens
  misc_feature: GZ8MTXP01CSJ6C.3.12.B01.1.454.CMB.2.raw
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
tcagagacgcactccacgaccggtgctcgatttagtagtgtagattccgcgggggaggaactgctcagttaggatccagacggaaccatggaagccccagcgcagcttctcttcctcctgctactctggctcccagatgccactggagaaatggggttgacgcagtttccagccaccctgtctgtgtctccgagggagagagccaccctctcctgcgacgggccagtcagtagtgttgacagctaacttggcctggtaccagcagcaacncggcagcctccagctccnatctatnatgacactcccacgacgggccaccggtactacccgacgccgtaggttcccaggtggcgtagggtcggtacgtagggaacgagtacgttcacctctacaccgatacacgacacgctcgactaggtcgtagtagttacgttcgacttaagtttactacgttgtacgactactaattaacaacgtacgtacgctcgtctcgtacggttcgggacggacggaccgaagggtgaagttacgacgaaacgtcgaggtcggctgactaaccgttaattcg

SEQ ID NO: 321333 - DNA, 560 bp, Homo sapiens
  misc_feature: GZ8MTXP01EBTFM.3.12.B01.1.454.CMB.2.raw
  modified_base (362)..(362): a, c, t, g, unknown or other
  misc_feature (362)..(362): n is a, c, g, or t
  modified_base (387)..(387): a, c, t, g, unknown or other
  misc_feature (387)..(387): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcagggccagtcagagtgttgacagcaacttggcctggtaccagcagcaacctggccaggctcccagcctcctcatctatgatgcatccaccgagggcccacggtctcccagccaggttcagtggcaggtcgggtctaggggaccnggtacgttcacgtctccgaccatcngcacgcctgcagtctgaggtactttgacttagtttattacgtggtactagtactattaacaattaacgtcgcctcggtctacgtacgttcgggaacggacgggaccgtagggttaggagtaacgttacgaaacgttacgtggttcggcgttcggaccaccgtaacttcgttcc

SEQ ID NO: 321334 - DNA, 656 bp, Homo sapiens
  misc_feature: GZ8MTXP01BBV05.3.12.B01.1.454.CMB.2.raw
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcgagggccagtcagagtgtgacagctaagttgccgtgaccagcagcacngccaggctccgngctcnatctatgatgcacnccacgacggcccacgtcnccgagaccgtaggttcaggtcggacgtagggtcggggtcgtaaggggaactggtacgttcccaccgtcctaccaccgtatccgacgcgtcgtcgttcgaccgttggtaccgttagggttaacgtttcgttttagaaccgtttaaggttttaactttaccggtggttaccggtaattaacccgttaagttaaacctaaaacgtttacccggttcggtaccgttccggtaccgttacgttaccgggttcgggggaacggttaacggacgggtaaagggttgaaacgtacgttaaccggaagttacgtgggtccgtaactcgaccttaccgtaagttcctaacg

SEQ ID NO: 321335 - DNA, 655 bp, Homo sapiens
  misc_feature: GZ8MTXP01CA24G.3.12.B01.1.454.CMB.2.raw
  modified_base (297)..(297): a, c, t, g, unknown or other
  misc_feature (297)..(297): n is a, c, g, or t
  modified_base (384)..(384): a, c, t, g, unknown or other
  misc_feature (384)..(384): n is a, c, g, or t
  modified_base (446)..(446): a, c, t, g, unknown or other
  misc_feature (446)..(446): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctcgaggggagagacgcccaccctctcctgcagggccagtcagtagtgttgacagctaacgttggcctaggtaccagcagccaacctggccaggccctcccgaggcctccnatctatgatgcactcccaccgagggacccacggtactcccagcctagggttcaaggtcggctaggggtcggggtcctagggggaacnggtacgtttccacttcctacaaccatccagccagtccctggactagtcgtaggtaaggtttntttacgattaagtttacttacgtacggtactagtacttaaacttaactaaacgttaaccgttcggtacccgtccggttaccttaccggtaaccgggttcgggggaaccgggtaacggggttaaccggtaaaggggttacggtaaacgtaacgttaaacgaaacggttacggttcggtacggtctacgtaccttacgttcgttccgttcg

SEQ ID NO: 321336 - DNA, 642 bp, Homo sapiens
  misc_feature: GZ8MTXP01A9OU6.3.12.B01.1.454.CMB.2.raw
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
  modified_base (368)..(368): a, c, t, g, unknown or other
  misc_feature (368)..(368): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgcccaccctctcctgcagggccagtcagagtgttgacagctaacgttggcctggtaccagcagcaaccgtggccaggcctcccgaggtcctcctcatctatgatgcactccacgnggcccacggtcncccgagccaggttcaggtggcagggtggtctagggacnggtactcactcctacacatcgagcacgcctagctaggtcgtaggtaggttactttaggactttaaggtttacttacgtcggggtaactaacgtacttaacgttaacaaacgttaaccgtcggtacccgtcgggtccttaccgttaccgggtttccgggaacgggggtaaaccgggttaaccggtaaaggggttcggtaaacgtaacgttaaccggaaaacggttaacgtgggtacggtaacgttcggaccttaacccgtgttccggtttaaccg

SEQ ID NO: 321337 - DNA, 725 bp, Homo sapiens
  misc_feature: GZ8MTXP01ERUMK.3.12.B01.1.454.CMB.2.raw
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcgagggccagtcagagtgtgacagcacgttggcctggtaccagcagcaaccgtggccaggcctccgagcctcncatcatgatgcactccgacgacggacccaacgtacnccccgagccgtaggttcaacggtcgggcgtaggggttcggggtacgtaacgggggaactaacggttacggttaccctaaccgttcccgtaaccctaacccggaactaccgaacgcgtaacgtcccgttaggccgtaaggtttccgtaagggttaagggtttattttacggacctttaaggttttaacttacgtttacgggtactaacgttaacttaaacgtaaactaaacgttaaccgtccggtaacccttccgggtaccgttacccgtttaccggggtttccggggaaaccgggtaacggggaccggttaagggttaacggaacgtaacgttaaaccggaaaacgttaccggttaaggtacggtccgttacggacccgttaaactcggtttcctttcg

SEQ ID NO: 321338 - DNA, 730 bp, Homo sapiens
  misc_feature: GZ8MTXP01EMSN7.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgcagtttccagccaccctgtctgtgtctccgaggggagagacgccaccctctcctgcagggccagtcagagtgttgacagctaacgttggcctggtaccagcagccaaccgtggccaggcctcccgaggcctcctcattctatgatcgcactcccgaccgacgggcccaaccggtactccccgagccgtaggttcacggtcggacgtagggtcggggtcgtaaggggaactaagggtacgttaccaaccttcctaccaacccgtattaccgacggtaccacggtcccgttggaccgtaacggtttccgttaggggttaacggtttaagtttttcggaaccgtttaaggtttttaaactttaccgttagggggttaccctaaggtaccttaaacgtttaaacctaaacgttaacccgttcggtaccccgttcgggtacccttaccggttaccggtttcggggaacgggtaacggggttaaaccgtaaggggttacggaaacgtaacgttaaccgaaaacggttacgtcgggtacggtccgtcggaccttaaccttaacgtttccgttcg

SEQ ID NO: 321339 - DNA, 570 bp, Homo sapiens
  misc_feature: GZ8MTXP01BAEPP.3.12.B01.1.454.CMB.2.raw
  modified_base (323)..(323): a, c, t, g, unknown or other
  misc_feature (323)..(323): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagcccaccctctcctgcagggccagtcagagtgttgacagctaacttggcctggtaccagcagcaacctggccaggctcccaggctcctcatctatgatgcatccacagggcccacggtacncccagccaggttcaggtggcaggtgggtcagggacngagttcactctacacntcagcagcctgcagtctggtagtatttgctagtttattacgtggtacagtactaagttaacaacttaacgtggtacccgtcggtcttaccgtacgtttcgggaacgggtaacgggaccgtaagggttaggaagtaacgttaacgaaacgttacgttggtacggtcgtacggccttacctaacgttccgtttaacg

SEQ ID NO: 321340 - DNA, 660 bp, Homo sapiens
  misc_feature: GZ8MTXP01DZXZG.3.12.B01.1.454.CMB.2.raw
  modified_base (456)..(456): a, c, t, g, unknown or other
  misc_feature (456)..(456): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcgagggccagtcagagtgttgacagactaacgttggcctggtaccagcagcaactggccaggcctccgaggcctcctcatctatgatgcactccgaccgagggcccctacggtactcccgacgccgtaggttcacggtgggacgtagggtcggggtcgtaaggggacctaagggtacgttaccaccttccgtaccaacctatccgacgcgacgcctcggctaggttacgtggtaaggttnttttacgacgttaagtttacttacgttggtactaggtacttaaacgttaactaacgttaacgtcggtacccgtcggtccttacgttaccggttccggggaacgggtaacgggaccgggtaaagggttaggaaacgtaacgttaaccgttaaacggttacggttcggtggtaaccgtacggaccttaccgtaacttccgtttccg

SEQ ID NO: 321341 - DNA, 661 bp, Homo sapiens
  misc_feature: GZ8MTXP01BMR81.3.12.B01.1.454.CMB.2.raw
  modified_base (264)..(264): a, c, t, g, unknown or other
  misc_feature (264)..(264): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagttccagccacctgtctgtgtctccgaggggagagacgcccaccctctcctgcgagggccagtcagagttgtagacagactaacgttggcctaggtaccngcagaccaaccgtggaccacggcctcccgaggcctcctcatctaatgactgacctactcccgaccggacggggacccctaaccggtacctccccaggtaccccgtaaggggttcgaacggtcgggtacgtaaggggttcgggggtccgtaacgggggaactaagggtacgtttccaaccgttcctaaccaaccgactacgacgtcacggtcctgacgtagttcgtagggtagtttactttaggctttaagtttaacttacgttaggtactacgtactaaactttaacgaacgtacgtcggtaccgtcggtcctacgtacggtcgggaacgggtacgggacgtagggagaagtacgaacgaacgttacgtcggtggctcgacttacctgttcttaacg

SEQ ID NO: 321342 - DNA, 693 bp, Homo sapiens
  misc_feature: GZ8MTXP01AXE1X.3.12.B01.1.454.CMB.2.raw
  modified_base (200)..(200): a, c, t, g, unknown or other
  misc_feature (200)..(200): n is a, c, g, or t
  modified_base (266)..(266): a, c, t, g, unknown or other
  misc_feature (266)..(266): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaanacgccaccctctcctgcagggccagtcagagtatagcagcaacttgcctggtaccagcaagaaccngccaggctcccaggcctcctcatctatcgctgcagtcccaccgacgggcctacgtcggtaactcccgagccgtacgggttcaggtggcgtagggttggggtcctgggggacctagggtacgtttcactttccgacaaccctagtaccgaacggtccgaacgttccccgtaggacctaaggtttaccgtaaggtaaacgtttagtttttaccggaaacttttaaacgtttttacgttacgtttacggttaccaaggttaaccgttaaagtttaaacttaaacgtttaaaccggttgggggttacccgggtaacggtttaccggggaaccgtaaagggggaccttaaaggggttaacaaagtaaccgaaaacggttacgttcgggttacgcttacggaacctaactcgttactaacgttccgtttaacc

SEQ ID NO: 321343 - DNA, 718 bp, Homo sapiens
  misc_feature: GZ8MTXP01AEKC0.3.12.B01.1.454.CMB.2.raw
  modified_base (159)..(159): a, c, t, g, unknown or other
  misc_feature (159)..(159): n is a, c, g, or t
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttnacgcagtttccagccaccctgtctgtgtctccgagggganagacgcccaccctctcctgcagggccagtcagtagtgttgacagctaacgttggcctggtaccagcagcaacctggcccaggcctccgaggcctcctnattctatgactcgaccacgtccccgaaccgtacggggaccctaacccgggttaactcccccgaaggtaccccgtaaaggggtttccgaagggttggggaccgtaggggttcgggggttacctaaggggggaacctaaggtacgtttacccaaaccgttccctaacgaaccctatacccgacgacctaacggtcccgttcggactacgttaccgtagggtaacggtttagtttttacgtacgtttaaggtttttactttaaccgttggggtactaacggtacttaacttaaacctaacgtaacgtcggtcccgtcggtcttaccgttacggtttccgggaacgggtacgggaaccgagggttaggaacgtaacttaacgaaacgttaccgtgtggtaactagaccttacgtaacttcgttcg

SEQ ID NO: 321344 - DNA, 626 bp, Homo sapiens
  misc_feature: GZ8MTXP01EMXJ5.3.12.B01.1.454.CMB.2.raw
  modified_base (375)..(375): a, c, t, g, unknown or other
  misc_feature (375)..(375): n is a, c, g, or t
  modified_base (429)..(429): a, c, t, g, unknown or other
  misc_feature (429)..(429): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcgagggccagtcagagtgttagacagactaacgttggcctaggtaccagcagcaactgcagctccagctcctcatctatgatgcactccaccgacggcccaccggtactcccgacgccgtaaggttccgaggtggacgtaggtcgggtcgtagggacnggtacttaccactctaccaacactacgagcacgcctgcctagtcgtaggtagtntttgacttagtttatacgtggtacagtactaactaactaactacgtcgtccgtacgtccttacgtaccggttcggggaacgggtaacgggttaaccggtaggggttacggtaaacgaacgttaaaccggttaaacggttaaccggttgggtacggtaaccgttacggacccgttaaccttcgtttccgtttaacccg

SEQ ID NO: 321345 - DNA, 605 bp, Homo sapiens
  misc_feature: GZ8MTXP01A5A2X.3.12.B01.1.454.CMB.2.raw
  modified_base (332)..(332): a, c, t, g, unknown or other
  misc_feature (332)..(332): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcagggccagtcagagtgttgacagctaacgttggcctggtaccagcagcaacctggccaggcctcccgagcctcctcatctatgatgcactcccaccgacgggacccaccggtcncccgagccgtaggttccaggtcggcgaggtcggggtcgtaaggggactggtacgtttccgacttccgtaccaccgtatcgacgcacgcctgcgtagtcgtaggtagttatttcgacttagtttacttacgtggtactagtactacttaacaatacgtcgtcctcgtcctacgttaccgttcgggaacggtacgggaccgtagggttacgaagtacttaacgaaacgttacgtggtacggtcgtacggaccttaccgtaacgttcgtttaaccg

SEQ ID NO: 321346 - DNA, 534 bp, Homo sapiens
  misc_feature: GZ8MTXP01EUZ8P.3.12.B01.1.454.CMB.2.raw
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
  modified_base (338)..(338): a, c, t, g, unknown or other
  misc_feature (338)..(338): n is a, c, g, or t
  modified_base (376)..(376): a, c, t, g, unknown or other
  misc_feature (376)..(376): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccagggagagacgccaccctctcctgcagggccagtcagagtgtgacagcaattgcctggacagcagcaactgccagctccagctcnatctatgatgcatccaccgaggcccacggtacnccagccagtcagtggnagtggctagggacngagttcactctacacatcagcagctgcagtctgtagtntttgctagttatactgtctagtacattaacaaatacgtcggtccctcggtctaccgtacgtttcggggcgggtaacgggacccgtaagggttacggaggtaacttaacgaaaacggttacgtgggtacgaacgttcggtacaccctaagttcttccgg

SEQ ID NO: 321347 - DNA, 590 bp, Homo sapiens
  misc_feature: GZ8MTXP01EE42Z.3.12.B01.1.454.CMB.2.raw
  modified_base (369)..(369): a, c, t, g, unknown or other
  misc_feature (369)..(369): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagcccaccctctcctgcagggccagtcagagtgtgacagcaacttggcctggtaccagcagcaacctggccaggcctccaggctcctcatctatgatgcactccaccgacgggcccaccggtactcccgagccaggttcaggtggcgtagggtcggtcgtaggggacnggtacgtttacacctctacaccatccagcacgcctgcagttctagtaggttatttgacttagtttattactggggtactagtacctaattaactaaatacgtcggtacctcgtcctacgttacggttccgggaacgggtacgggttaaccgtaaagggttggaagtaacgttaacgaaacggttacgtggtaggtctcggaccacgtaacttcggttaacg

SEQ ID NO: 321348 - DNA, 719 bp, Homo sapiens
  misc_feature: GZ8MTXP01B9SCS.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtcctccgaggggagagacgcccaccctctcctgcgagggccagtcagtagtgttagacagactaacgttggcctaggtaccagcacgcaaccgtggccaggcctcccgaggcctcctcatctatgatgacacgtacccaccgacgggaccctaaccggtctaccccgacgtccgtagggttccacggttcgggacgtaggggttcggggtacgtaacggggaacctaagggtacgttacccgaacttcccgtaaccctaacctaacgtaccacggtacccaacggtcccgtaggtaccgtacggtaccgttagggtaggttttacgttttacggacgtttaagttttaacgtttacgttcggtacgtacgtaccgtacggtacgtaccgtaccgtaacgtcccggtcccttccgttaccggttaccggtttcggggaaccggggtaacgggttaccggtaagggttacggaaagtacgttaaaccgaaaggttacgtcgggtgaacgttcgaccttacttcgttctttaaccg

SEQ ID NO: 321349 - DNA, 638 bp, Homo sapiens
  misc_feature: GZ8MTXP01ESEZG.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccgaggggagagacgccaccctctcctgcgagggccagtcagagttgtgacagctaacttggcctaggtaccagcacgcaacctggccaggcctcccgagcctcctcatctatgatgactactacccaccggtacggacccctacggtactcccgagtccaggttcacggtcggcgtagggtcggggtccgtaacggggactaaggtacgtttccaaccttccgtaccaacacgtacacgtcacggtcctaggcctagttaccgtaggttaggttaatttgacgtttaagtttacttaccgtggggtactaagtactaagttaacaaagttcgtcgtccgtacgtctaccgttacgggtcgggaacggtaacgggacgaaagggttcggaataacgttaacgaaacggttcggttaagcggtcgtacgaccttactaagttccgttaacg

SEQ ID NO: 321350 - DNA, 658 bp, Homo sapiens
  misc_feature: GZ8MTXP01CP744.3.12.B01.1.454.CMB.2.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccgagggganagacgccaccctctcctgcagggccagtcagagtgttgacagactaacgttggcctgggaccagcagcaaccgtggccaggcctccgaggcctccncatctatgatcgctactccaccgtaggggccccaaccgggtactccccgagaccgtagggtttccaaggtgggacgtagggttcggggtccgtaagggggactaagggtacgtttaccaacttctacccaccatacgacgcgacggtcctcgcgtagtacgtggtaagttgtttgacttaagtttacttacgttcgggttctaacgtacttaaacttaaacgtaaacttaaccgttcggtacccgtcggtcctaccgttacgtttacgggaacggtaacgggttaccgtaagggttacggaacggaacttaacgaaacgttacgtcggtacgtcgtacgaccttaccgtaacgttcgtttaacg

SEQ ID NO: 321351 - DNA, 723 bp, Homo sapiens
  misc_feature: GZ8MTXP01B18T2.3.12.B01.1.454.CMB.2.raw
  modified_base (263)..(263): a, c, t, g, unknown or other
  misc_feature (263)..(263): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgcagtttccagccacctgtctgtgtctccgaggggagagacgcccaccctctcctgcgagggccagtcagagtgttgacagctaacgttggcctggtaccngcagcaaccgtggccaggcctcccgaggtcctcctcatctatgatgaccactaccccaccggacgggcccctaacccgggtactaccccgacggtcctacggggttccaggtcgggacgtaggggttccggggtcgtaaggggaactaaggtacgttccaacccttcctaccaacccgtataccgacgaccgacgtcccgtgaccgtacgggttacgtagggttacggtttatttttcggacgtttaagttttacttaccgttaggggttactaaacggttacttaaactttaaacgaaacgttaaccgttcggtacccttccgggtccttaccggttacggtttaccgggggaacgggtaacgggttaaaccgggtaaaggttacgggtaaacgtaacgttaaaccggttaacggttaaccgtgggtacgtcgtacggtaccacgttaacttcgtttcg

SEQ ID NO: 321352 - DNA, 695 bp, Homo sapiens
  misc_feature: GZ8MTXP01EIJX9.3.12.B01.1.454.CMB.2.raw
  modified_base (231)..(231): a, c, t, g, unknown or other
  misc_feature (231)..(231): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgcagttccagccaccctgtctgtgtctccgaggggagagacgccaccctctcctgcgaggccagtcagngtgtgacagcaacttcggcctgtaccagcagcaaccgtgccaggcctccgagcctcncatctangntgcactccgaccgacggacccctaacggtacctcccgaacggtcccgaaggtttcgaacggttcggacggtaggtcggggtacgttacgggggaaactcgggttacgtttaccgaccgttaccgttaaccccgaaccttaaacggtcctaaacgggtacccgtaccgtccgtacgtacgtacgttacgttacggttacgtttacgtttacgttacgtttaacgtttaacgtttacgttacggttacgtacgttaacgttaacttaaactaacgttacgtacgtaccgtcgtcgtacgttacggtacgggtaacggtaacggttacggtaggttaggtaacgtaacgttaacgttaacgttacggtaaggtcgtcgtacgtacgttacgtcgttcgtcg

SEQ ID NO: 321353 - DNA, 673 bp, Homo sapiens
  misc_feature: GZ8MTXP01ACC1R.3.12.B01.1.454.CMB.2.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgcagtttccagccaccctgtctgtgtctccgagggganagacgcccaccctctcctgcgagggccagtcagtagtgtgacagctaacgttggcctggaccagcagcactgccagcctccgagcctcctnatctatgatcgacctactccccaccggaccgggccctaaccgggttaccnccccgagcccgtaggttccaggtcggacgtaggtcggggtacgtaagggaccgaaggttcgttacccacttcctacaacactacgacgaccgtacgccccgtaggacccgtaggttaccgtagggttaaacgggtttattttacggtaacctttaaggtttttaactttacggttacggtacgtaacgtacttaacgttaaactaaacgtcgtccgtaccgttcggtcttaccgtacggttcggggaacgggaacgggacctaagggttacgaacgtaacgacgaaaacgttcgtaacggtcgaacgtcgaccacttaacttcgtttaaccg

SEQ ID NO: 321354 - DNA, 690 bp, Homo sapiens
  misc_feature: GZ8MTXP01B5VMG.3.12.B01.1.454.CMB.2.raw
  modified_base (660)..(660): a, c, t, g, unknown or other
  misc_feature (660)..(660): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagcccacctgtctgtgtctccgaggggagagacgccaccctctcctgcgacgggccagtcagagttgtgacagactacgttggcctgggaccagcacgccaacgtggccaggcctccgaggcctcctacatctatgactcgcactccgaccgacggaccccgacggtactacccgaggtacccgtaggttcaacggtcggacgtcgggtggggtcgtaacggggaacctaaggtcgttaccctacgttcctaccaccctactaccgtacggcctaggtccctgaccgtcgtacgttgtaacgggtttacttttcgactttaagttttacgtacgttacgggtcgtaagttaccttaaattaaacccgtaaacgttaccgtcgggtaccccgttcgggtccttaccggttccggggttaccgggggaacgggtaaaccgggttacggaaaggttcggaaagaccgttaacgaacggttaccgtgggtccgngttaccgacgttaccgtgttccgttaaccg

SEQ ID NO: 321355 - DNA, 568 bp, Homo sapiens
  misc_feature: GZ8MTXP01ELNGS.3.12.B01.1.454.CMB.2.raw
  modified_base (289)..(289): a, c, t, g, unknown or other
  misc_feature (289)..(289): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcgagggccagtcagagtgtgacagcaacttggcctggtaccagcagcaactggccaggctccgagcctcctnatctatgatgcactccaccgagggcccaccggtatcccgagcctaggttcaggtcggcgtaggtgggtcgtaaggggacaaggagttccactcctacacatcagcacgcctgcagttcgtaggtaggttatttgacttagtttacttacgttggttacagtactaattaactaaataacgtggccgtcggtctcgtacgttcgggaacggtacgggaccgtagggttcgaagtaacttacgaaacgttacgtggcggctcgaccactaacgttcgttcg

SEQ ID NO: 321356 - DNA, 653 bp, Homo sapiens
  misc_feature: GZ8MTXP01BDKUG.3.12.B01.1.454.CMB.2.raw
  modified_base (240)..(240): a, c, t, g, unknown or other
  misc_feature (240)..(240): n is a, c, g, or t
  modified_base (332)..(332): a, c, t, g, unknown or other
  misc_feature (332)..(332): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcagggccagtcagagtgttgacngcaacgttggcctggaccagcagcaacctggccaggcctcccgaggcctcctcatctatgatcgcactccaccgacgggccccaccggtacncccgagccgtaggttcacggtcggactagggtgggtccgtaggggactaaggtacgttccacttccgtacacctatccgacgtcgacggcctacgcgtagttacgtaggtagggttatttgtacgttagtttacttacgttgggttactaagtactaaactttaacgtaaacgttaaccgtcggtaccctacggtccttaccgtaccgggtttcgggaaccgggtaacggggttacccggtaagggttgggaaacgtacgaaaccgttaaacggttaacgtgggtaccggtcgtcggtaccaaccgtcgtttccgtttccg

SEQ ID NO: 321357 - DNA, 563 bp, Homo sapiens
  misc_feature: GZ8MTXP01BOXCG.3.12.B01.1.454.CMB.2.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (357)..(357): a, c, t, g, unknown or other
  misc_feature (357)..(357): n is a, c, g, or t
tcagagacgcactccacgaccggtgctcgatttagtagtgtagattccgcggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgttgacagcaacttggcctggtaccagcagcaacctggccaggctcccaggctcctnatctatgatgcatcccacgaggcccacggtatcccagccaggttcacgtggcaggtcgggtctggggacnggacgttcactctacaccatcagcagctgcagtcgtgtaggtatttgctagtttattacgtgtctagtctacttacgaactacgtacgcctacgtctccgtacgtttcggcgggtaacgggaccgtaagggttacggtaacggtaacttaccgaaaccgttaacgtggtacgggtcgttcggaccgaccgtaacgttcttaaccgg

SEQ ID NO: 321358 - DNA, 649 bp, Homo sapiens
  misc_feature: GZ8MTXP01A4834.3.12.B01.1.454.CMB.2.raw
  modified_base (299)..(299): a, c, t, g, unknown or other
  misc_feature (299)..(299): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgcccaccctctcctgcgagggccagtcagtagtgttgacagctaacgttggcctgggtaccagcagcaaccgtggccaggcctcccgaggcctccnatctatgatcgcactacccgacgacgggccccacggtactcccgagccgtaggttcacggttcggcgtagggtcgggtcgtaggggactggtacgttccacttcaccacatcacgtcacgtcctgctagtctgtaagttctttgacttaagtttacttactgggtactacgtactaaacgtttaaacaacgttaccgtcgggtccttcgggtacttaccggtcgggtttccggggaacggggtaacgggttaaaccgttaaggggcggtaaagtaaccgttaaaccgttaaaacggttccgtttaagggccgggtaacttcccggattaccctaagtttccgtttaaccg

SEQ ID NO: 321359 - DNA, 675 bp, Homo sapiens
  misc_feature: GZ8MTXP01BHL03.3.12.B01.1.454.CMB.2.raw
  modified_base (199)..(199): a, c, t, g, unknown or other
  misc_feature (199)..(199): n is a, c, g, or t
  modified_base (261)..(261): a, c, t, g, unknown or other
  misc_feature (261)..(261): n is a, c, g, or t
  modified_base (291)..(291): a, c, t, g, unknown or other
  misc_feature (291)..(291): n is a, c, g, or t
tcagagacgcactccacgaccggtgctcgatttagtagtgtagattccgcggggggaggaactgctcagttaggacccagacggaaccatggaagccccagcgcagcttctcttcctcctgctactctggctcccagatgccactggagaaatggggttgacgcagtttccagccacctgtctgtgtctccgagggganagacgcccaccctctcctgcgacggccagtcagagtgtgacagctaacgttggctggtaccngcagcaacgtggccagcctccgagcctccncatctatgatgccatcccgaccgacgggacccctacggtactacccagtccgtaaggttcacggtggacgtagggttcggggtacgtaagggactaacgggtacgttaccaccttcctacgaccagtaccgacgtacgacggtcctggaccgtaggtacgtaggtagtttcgttttagacgtttaaggtttattacccgttaggggtactaacggtactaaactttaacgaaaacgttcgtaccgggtacccgttcggtaccgtttacgtacccgggttttacggggaacgggtaacgggttaaaccggtaagggttacggtaagtaaccttaacgggaacgttaacggtcgaggtcctaggaccacgtaaccgtttctaaccg

SEQ ID NO: 321360 - DNA, 649 bp, Homo sapiens
  misc_feature: GZ8MTXP01BYHRF.3.12.B01.1.454.CMB.2.raw
  modified_base (198)..(198): a, c, t, g, unknown or other
  misc_feature (198)..(198): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccgagggganagacgcccaccctctcctgcgagggccagtcagagtgttagacagctaacgttggcctggtaccagcagcaacctggccaggcctcccgaggtcctcctcatctatcgatcgactactacccgaccgtacgggccctaaccgggtactacccgagtccgtaagggtttccaaggtcggtacgagggttcggggtacgtaacggggaacgaaggtacgtttacccacttacctacaacctacgtacaggcaccggtctacgcctaaggttcgtaggtaggtttactttggcttaagtttactacgtgtcaacgtactaaacttaactaaacgtccgtcgttacccgtccggtacctaccgttcgggttcggggaacgggtaaacgggttaccgaagggttggaaactacttaacggaaacgcgtggtcggctgacttacctggttcttaacg

SEQ ID NO: 321361 - DNA, 593 bp, Homo sapiens
  misc_feature: GZ8MTXP01AP1XB.3.12.B01.1.454.CMB.2.raw
  modified_base (159)..(159): a, c, t, g, unknown or other
  misc_feature (159)..(159): n is a, c, g, or t
  modified_base (232)..(232): a, c, t, g, unknown or other
  misc_feature (232)..(232): n is a, c, g, or t
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttnacgcagtttccagccacctgtctgtgtctccaggggagagagcccaccctctcctgcagggccagtcagagtnttgacagcaattggcctggtaccagcagcaacctggccaggctccaggctcctcatctatgatgcatccacaggccacgatcccanccagttcagtcggnagtcggtctaggggacngagttccaacttcacacctanacagacacgactacgacgtagtacgtagtagtagtttagtacgtaagtttaacgttacttaggtacgtacgtactaactaactaaataacgtacgtaccgtcgtcctacgttacgttcgggtaacgggaacgggaacggtaaacgggttaaggtaacggtaacgttaacgaaaacgttaaacgtaacggtacggtcgtcgtacgttacctaacgttaacgtcg

SEQ ID NO: 321362 - DNA, 514 bp, Homo sapiens
  misc_feature: GZ8MTXP02GH9Q6.3.12.B01.1.454.CMB.2.raw
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
tcagagacgcactccacgaccggtgctcgatttagtagtgtagattccgcggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggcctcccaggcctcctcatctatgatgcatccaccgagggcccaccggtatccccagccaggttcagtggcaggtgggtctggggacnggattcactcncacatcagcagcctgcagtctgaggtatttgctagtttattactgtcagctattacaataactggcctcggctctacgtttcggcggtacgggaccaagggtggaagacgtacgaaacgaactggtaggctacgcaccatctg

SEQ ID NO: 321363 - DNA, 605 bp, Homo sapiens
  misc_feature: GZ8MTXP02GA6GG.3.12.B01.1.454.CMB.2.raw
  modified_base (198)..(198): a, c, t, g, unknown or other
  misc_feature (198)..(198): n is a, c, g, or t
  modified_base (288)..(288): a, c, t, g, unknown or other
  misc_feature (288)..(288): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgttgacagcaacttggcctggtaccagcagcaacctggccaggctcccaggctcctnatctatgatgcatccaccagggcccaccggtatcccacgcgacggtcaccgtggcgagtagggtcgtcgggtacgagtaggttctactcctcaccactacacgcacgcctcgtacacgtactgtaggtaagttttgtcgtatttaagtttaacttcggttctagtactaattaactaaactaacttacggtccgtcgtccgtacgtaccgtttacgggtcgggacgggtacggaaacgggttagggaacggacgtaacgtaaaccggtaaaacgtggttacggtaacgtcggtactaacccgaacttacgtttccgg

SEQ ID NO: 321364 - DNA, 518 bp, Homo sapiens
  misc_feature: GZ8MTXP02ITFPF.3.12.B01.1.454.CMB.2.raw
  modified_base (308)..(308): a, c, t, g, unknown or other
  misc_feature (308)..(308): n is a, c, g, or t
  modified_base (356)..(356): a, c, t, g, unknown or other
  misc_feature (356)..(356): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggcctcctcatctatgatgcatccacgngggcccaccggtatccccagccaggttcagtgcagtgggtctgggacnggagttcactctcacatcagcagcctgcagtctgaggtatttgactagtttattactgtcagtctattacaatactggcctcggctcacgtttcggacggaggaccgaagggtaggacgacgtacgaaacgtaacgtgtacggctaggccacctacttctcg

SEQ ID NO: 321365 - DNA, 503 bp, Homo sapiens
  misc_feature: GZ8MTXP02FXK2V.3.12.B01.1.454.CMB.2.raw
  modified_base (354)..(354): a, c, t, g, unknown or other
  misc_feature (354)..(354): n is a, c, g, or t
  modified_base (386)..(386): a, c, t, g, unknown or other
  misc_feature (386)..(386): n is a, c, g, or t
tcagagacgcactccacgaccggtgctcgatttagtagtgtagattccgcggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaactggccaggctcccaggctcctcatctatgatgcatccacagggcccaccggtatccccagccaggttcagtgcaggtgggtctggggacngagttcactctcacatcagcagcctgcagtcngaggtatttgctagtttattactgtcagctattacaatactgacctcgctctacgttcggcggaggaccgaaggtggagacgtacgaaacgaacgtgtacggctcgacaccatctag

SEQ ID NO: 321366 - DNA, 562 bp, Homo sapiens
  misc_feature: GZ8MTXP02I0CO9.3.12.B01.1.454.CMB.2.raw
  modified_base (288)..(288): a, c, t, g, unknown or other
  misc_feature (288)..(288): n is a, c, g, or t
  modified_base (357)..(357): a, c, t, g, unknown or other
  misc_feature (357)..(357): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggcctccncatctatgatgcatccacgagggcccaccggtatcccagccaggttcagtgcaggtgggtctggggacnggtacgttcactctccaccatcagcacgcctgctagtctggagttgtttgacttagtttatacgttgtactagtactaattaactaaactacgtcggtccgtcggtcttacgtacgtttcgggacgggtacgggaccggaaagggtaggaacgtacgtaaccgaaaacgtacgtggtacgcgtacgacctaaccgtacttcgtcg

SEQ ID NO: 321367 - DNA, 404 bp, Homo sapiens
  misc_feature: GZ8MTXP02JZHH6.3.12.B01.1.454.CMB.2.raw
  modified_base (395)..(404): a, c, t, g, unknown or other
  misc_feature (395)..(404): n is a, c, g, or t
tcagagacgcactccacgaccggtgctcgatttagtagtgtagattccgcgggttgtagtcggtgctcccaccatagtgggagcaccgactacaacccgtccctcaagagtcgagtcaccatatcagtagacacgtccaagaatcagatctccctgaacgtgacctctgtgacggccgcagacacggctgtttattattgtacgggccgtgtaacgttggactactggggccagggaaccgtggtcaccggtctcctcagcctccaccaagggcccatcggtcttccccctggcaccctcctccaagagcacctctgggggcacagcggccctgggctgcctggtcaaggactacttccgagtgcgtcctctgagcgggctggcaggcgcatagnnnnnnnnnn

SEQ ID NO: 321368 - DNA, 592 bp, Homo sapiens
  misc_feature: GZ8MTXP02JNGGL.3.12.B01.1.454.CMB.2.raw
  modified_base (198)..(198): a, c, t, g, unknown or other
  misc_feature (198)..(198): n is a, c, g, or t
  modified_base (368)..(368): a, c, t, g, unknown or other
  misc_feature (368)..(368): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgtgacagcaacttggcctggtaccagcagcaacctggccaggcctcccgaggcctcctcatctatgatgcatccaccgaggcccacggtactccccgagcccgaggttcaggtcggactagtggggtctggggaacnggtgttcacttcacacatcagcacgcctgacagtctggagttacttttgacgttagttttactacgttagtcagtacttaattaaccaaattaaccgtcggtccctcggtcctacgttacgtttcgggacgggtacgggaccgtaaaggggtgggaacgtacgtaaacccgaaaggtaacgtggtacgggtacctacggacctaacccggtattacgtttaccg

SEQ ID NO: 321369 - DNA, 536 bp, Homo sapiens
  misc_feature: GZ8MTXP02IW39S.3.12.B01.1.454.CMB.2.raw
  modified_base (368)..(368): a, c, t, g, unknown or other
  misc_feature (368)..(368): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggcctcccgaggcctcctcatctatgatgcactcccaccgacgggcccaccggtactccccagccaggttcaggtggcaggtgggtctggggacnggtacgttcactctcacatcagcacgcctgctagtcgtgaggttatttgactagtttattacttgtcagtctattaacaatacgtcgtctcggctactacgttcgggacggacgggacgagggtggagacgtacgaaacgtagtggtggctacgacacgtactcgtcg

SEQ ID NO: 321370 - DNA, 512 bp, Homo sapiens
  misc_feature: GZ8MTXP02HLYIJ.3.12.B01.1.454.CMB.2.raw
  modified_base (289)..(289): a, c, t, g, unknown or other
  misc_feature (289)..(289): n is a, c, g, or t
  modified_base (320)..(320): a, c, t, g, unknown or other
  misc_feature (320)..(320): n is a, c, g, or t
  modified_base (354)..(354): a, c, t, g, unknown or other
  misc_feature (354)..(354): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggcctcctnatctatgatgcatcccacagggcccacggtncccagccaggttcagtgcaggtggtctggggacnggtcgttcactcctcaccatcagcagcctgcagtctgagtatttgctagtttattatgtnanctattacaatacgtgctcgctctacgtttcggacggacggacgaacgggtggaacgtactaacgaaacgacgtgtggactacgacaccagttctcg

SEQ ID NO: 321371 - DNA, 504 bp, Homo sapiens
  misc_feature: GZ8MTXP02HRM3M.3.12.B01.1.454.CMB.2.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
  modified_base (348)..(348): a, c, t, g, unknown or other
  misc_feature (348)..(348): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggcaagtcagagtgttgacagcaacttggcctggtaccagcagcaactggccaggctcccagctcctnatctatgatgcatccacaggccaccggtancccagccaggttcagtgcagtggtctgggacngagttcactctcaccatcagcagcctgcagtctgagtatttgctagttattactgtcagctattaacaataaactggcctcggctctacgtttcggcggagggaccaaaggtggagaagtaccgaaaagaacgtgtaggctacgacacctatctcg

SEQ ID NO: 321372 - DNA, 553 bp, Homo sapiens
  misc_feature: GZ8MTXP02JB0GG.3.12.B01.1.454.CMB.2.raw
  modified_base (284)..(284): a, c, t, g, unknown or other
  misc_feature (284)..(284): n is a, c, g, or t
  modified_base (355)..(355): a, c, t, g, unknown or other
  misc_feature (355)..(355): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacactgtctgtgtctccaggggagagagccaccctctcctgcagggccagtcagagtgttgacagcaacttggcctggtaccagcagcactggccagctcccaggctccncatctatgatgcatccaccagggcccaccggtactccccagcctaggtccagtggcaggtggtctgggacngagttcactctcaccatcagcacgcctagcgagtcgtgaggttatttagtacttagtttattacgtgtctagtctaattaactaaataacgtcggccttcggactcgtaccgtttcgggacgggtacgggaaccggtaaagggtacggacgaacgtaacgaaacgtaacgtaggtacggcgtacgaccacgtacttcg

SEQ ID NO: 321373 - DNA, 510 bp, Homo sapiens
  misc_feature: GZ8MTXP02GSEOF.3.12.B01.1.454.CMB.2.raw
  modified_base (288)..(288): a, c, t, g, unknown or other
  misc_feature (288)..(288): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgtgacagcaacttggcctggtaccagcagcaacctggccaggctcccaggctcctnatctatgatgcatccaccagggcccaccggtatccccagccaggttcagtggcaggtggggtcngggacnggtagttcactctcacatcagcagcctgcagtctgaggtatttgctagtttatactgtcagctattacaataactggacctcggctctacgttcggacggagggaccaagggtggagacgtacgaaacgacgtggtgactcgacacatctcg

SEQ ID NO: 321374 - DNA, 716 bp, Homo sapiens
  misc_feature: GZ8MTXP02F7OVG.3.12.B01.1.454.CMB.2.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggaagaaagtggggttgacgcagtttccatccacctgtctgtgtctccgagggganagacgccaccctctcctgcagggccagtcagagtgtgacagcaacttggcctggtaccagcagccaaccgtggccaggcctcccgaggcctcctnatctatgatcgacactcccaaccgacggggcccctaaccgggtactcccccgaaggtccccgtaagggtttccaacggttcggggacctaggggttcggggtctgggggaaactgggtaacgtttccaaccttcctacccaaaccctagtacccaaacggccaacggtcccgtaggacctaaggttccgtaggggtaacgggtttaatttttcgggaacctttaaggtttttaaacttaccgttagtaccgtaaggtaccttaaaactttaaacctaaaacgttaaccgtccggtacccgtttacgggtcccttaccgtaaccggtttcggggaaccggggtaacggggtaaaccgtaagggtacggaagtaaccgtaacgaaacgtaacgtgtacggctacgactaccgtattcgttacg

SEQ ID NO: 321375 - DNA, 535 bp, Homo sapiens
  misc_feature: GZ8MTXP02GZNQO.3.12.B01.1.454.CMB.2.raw
  modified_base (199)..(199): a, c, t, g, unknown or other
  misc_feature (199)..(199): n is a, c, g, or t
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
tcagagacgcactccacgaccggtgctcgatttagtagtgtagattccggcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgtgacagcaacttggcctggtaccagcagcaacctggccaggctcccgagcctcctcatctatgatgcatcccacgacgggcccaccggtanccccagccctaggttcaggtgcaggtgggctgggaacnggagttcactctcaccatcagcagcctgcagtctagaggtattttggactagtttatacttgtactagctaattaacaaattaacgtggccttcggctcgtacgttcgggacggtagggacctaagggtgaagactaacgaaacgacgtggtaggctagcctacctatcgtcg

SEQ ID NO: 321376 - DNA, 554 bp, Homo sapiens
  misc_feature: GZ8MTXP02JDIZU.3.12.B01.1.454.CMB.2.raw
  modified_base (198)..(198): a, c, t, g, unknown or other
  misc_feature (198)..(198): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgtgacagcaacttggcctggtaccagcagcaacctggccaggcctcccaggcctcctcatctatgatgcatccaccgacgggccctaccggtatccccgagccctaggttcaggtggcaggtcgggtctagggacngtagtcactctcacatcancagctgcagtctgagtatttgactagtttattactgtcagtctattaacaataacgtcggacctcggcctacgtacgtttccgggacgggtacgggaccgtaaagggtacggaagtacgtaaccgaaacgaacgtgtacgggactacggaccacctacttacgtttcg

SEQ ID NO: 321377 - DNA, 526 bp, Homo sapiens
  misc_feature: GZ8MTXP02H87BH.3.12.B01.1.454.CMB.2.raw
  modified_base (318)..(318): a, c, t, g, unknown or other
  misc_feature (318)..(318): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
tcagagacgcactccacgaccggtgctcgatttagtagtgtagatcccgcggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggcctcccaggctcctcatcatgatgcatccaccagggccacggtancccagccaggttcagtggcaggtgggtctggggacagagttcactctcaccatcancancctgcngtctgagtatttgctagtttatttactgtctagtctaattacaaataactaggcctacggcttcgtacgtttcggcggaggggtaccgaaaggtggagaacgtacgaaaacgactaaggtggactaggaccaccacttcgtag

SEQ ID NO: 321378 - DNA, 731 bp, Homo sapiens
  misc_feature: GZ8MTXP02JXPY5.3.12.B01.1.454.CMB.2.raw
  modified_base (200)..(200): a, c, t, g, unknown or other
  misc_feature (200)..(200): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagcccaccctgtctgtgtctccgagggganagagccaccctctcctgcagggccagtcagagtgttgacagcaacttggcctggtaccagcagcaacctggccaggctcccgaggcctcctcatctatgatcgcatccaccgaggcccacggtctcccagcctaggttcacggtggctaggtcggggtctaggggacaggtacgtttccaaccgttcctaccgaaccctagttccgaacgccgaacgtcccgttggacccgtaacggttccgtagggtaacgggtttaagtttttcgggacctttaaaggtttttactttaaccgtttcggttacctaacggtaccttaaacgttttaaaactaaacgtttaaaccggttccggttaaccccggttccggtaccgtttacccgttaacccgggtttttacccgggaccgggggttaaaccgggggtaacccggaaagggggttacgggtaacggaaacgttaaaccgaaaaaccgggtacgttggttacgggtaccgttacggacccgtaaccgtacttccggtttaaccg

SEQ ID NO: 321379 - DNA, 521 bp, Homo sapiens
  misc_feature: GZ8MTXP02JSMXX.3.12.B01.1.454.CMB.2.raw
  modified_base (358)..(358): a, c, t, g, unknown or other
  misc_feature (358)..(358): n is a, c, g, or t
  modified_base (390)..(390): a, c, t, g, unknown or other
  misc_feature (390)..(390): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgtgacagcaacttggcctggtaccagcagcaacctggccaggctcccaggcctcctcatctatgatgcatccaccagggcccaccggtatcccagcccaggttcagtggcaggtgggtctggggacngagttcactctcacatcagcagcctgcagtcngagtatttgctagtttatactgtcagctattacaataacgtcgcctcggctcgtacgtttcggacggtagggaccgaagggtcggagtacgtacaaacgaacgtggtcggtactggaccaccgtatcgtcg

SEQ ID NO: 321380 - DNA, 584 bp, Homo sapiens
  misc_feature: GZ8MTXP02IJ0DD.3.12.B01.1.454.CMB.2.raw
  modified_base (291)..(291): a, c, t, g, unknown or other
  misc_feature (291)..(291): n is a, c, g, or t
  modified_base (325)..(325): a, c, t, g, unknown or other
  misc_feature (325)..(325): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccatctcctgcagggccagtcagagtgtgacagcaacttggcctggtaccagcagcaacctggccaggcctcccgaggcctcctnatctatgatgcatccacgagggcccaccggtacncccagccaggttccaggtgcaggtggtcngggcagtagttcacttcncacatcagcagcctgcagtctggagtatttgtaagtttattacttgtactagtctaatttaacaaattaacgtcggtacctcggtaccttccgtaacgtttccggggacgggtaacggggtaaccggtaaagggtacgggaaacggtacgtaaccgaaaacggtaacgtaagggtacggaccgttacggaacctaaccgtagtttcgttacg

SEQ ID NO: 321381 - DNA, 506 bp, Homo sapiens
  misc_feature: GZ8MTXP02JKKYE.3.12.B01.1.454.CMB.2.raw
  modified_base (197)..(197): a, c, t, g, unknown or other
  misc_feature (197)..(197): n is a, c, g, or t
  modified_base (319)..(319): a, c, t, g, unknown or other
  misc_feature (319)..(319): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (422)..(422): a, c, t, g, unknown or other
  misc_feature (422)..(422): n is a, c, g, or t
tcagagacgcactccacgaccggtgctcgatttagtagtgtagattccgcggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgttgacagcaacttggcctggtaccagcagcaacctggccaggctcccaggcctcctcatctatgatgcatccaccaggcccacggtancccagccaggttcagtgcagtggtcngggacngacgttcactctcacatcagcagcctgcagtctgagtatttgctagtttatactgtcagcattacaatacngctcgctctacttcgggcgagggtaccaagggtggaagtacgtacaaaacgtaactggtaggacctaggaccacctatccgttg

SEQ ID NO: 321382 - DNA, 548 bp, Homo sapiens
  misc_feature: GZ8MTXP02JNXYR.3.12.B01.1.454.CMB.2.raw
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccacgagggcccaccggtatcccagccaggtcagtgcaggtggtctgggacnggagttcactcncaccatcagcagcctgcagtctgaggtatttgactagtttattactgtctagtctattaacaaattaacgtcggtacctcggtccttaccgtacgtttcgggacgggtacgggaccgaacgggtaggaagactaaccgaaacgtaacgtggtacggacgtacgacctaccgtacttcgttacg

SEQ ID NO: 321383 - DNA, 541 bp, Homo sapiens
  misc_feature: GZ8MTXP02HYD79.3.12.B01.1.454.CMB.2.raw
  modified_base (198)..(198): a, c, t, g, unknown or other
  misc_feature (198)..(198): n is a, c, g, or t
  modified_base (323)..(323): a, c, t, g, unknown or other
  misc_feature (323)..(323): n is a, c, g, or t
  modified_base (361)..(361): a, c, t, g, unknown or other
  misc_feature (361)..(361): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgttgacagcaacttggcctggtaccagcagcaacctggccaggctcccaggcctcctcatctatgatgcatccaccagggcccaaccggtanccccagcccaggttcagtggcaggtgggtctggggacnggagttcactctacaccatcagcagcctgcagtctgaggtatttgctagtttattactgtcagctattacaataactggcctcggcttcgtacgtttcgggacgggtaacgggaccgaaaggtcggaagtacgtaccgaaaacgacgttggtcgggactcggaccaaccctagttcgtcg

SEQ ID NO: 321384 - DNA, 533 bp, Homo sapiens
  misc_feature: GZ8MTXP02FVJSP.3.12.B01.1.454.CMB.2.raw
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (394)..(394): a, c, t, g, unknown or other
  misc_feature (394)..(394): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccgagggcccaccggtatccccagccaggttcagtgcagtgggtcnggggacnggngttcactcctacaccatcagcacgcctgcagtcngagtatttgactagtttattactgtcagtctattaacaatacgtggtcctcggctctaccgtttcgggacggtagggaccgaagggtggaagtactacgaaacggtaacgtggtacggctacggaccaccgtatcttcg

SEQ ID NO: 321385 - DNA, 486 bp, Homo sapiens
  misc_feature: GZ8MTXP02IWZ35.3.12.B01.1.454.CMB.2.raw
  modified_base (266)..(266): a, c, t, g, unknown or other
  misc_feature (266)..(266): n is a, c, g, or t
  modified_base (317)..(317): a, c, t, g, unknown or other
  misc_feature (317)..(317): n is a, c, g, or t
  modified_base (348)..(348): a, c, t, g, unknown or other
  misc_feature (348)..(348): n is a, c, g, or t
  modified_base (384)..(384): a, c, t, g, unknown or other
  misc_feature (384)..(384): n is a, c, g, or t
  modified_base (423)..(423): a, c, t, g, unknown or other
  misc_feature (423)..(423): n is a, c, g, or t
tcagagacgcactccacgaccggtgctcgatttagtagtgtagattccgcggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagcccaccctctcctgcagggccagtcagagtgttgacagcaattggcctggtaccagcagcaaccnggccaggctcccaggctcctcatctatgatgcatccacaggccaccggtancccagccaggtcagtgcagtggtctgggacngtgttcactctcacatcagcagctgcagtctgagtntttgctagtttatactgtcagctatacaatactgctcgntcacgttcggcggaggaccaagggtgagactacgaaagacgtgacggctacgcaccgatcgtg

SEQ ID NO: 321386 - DNA, 528 bp, Homo sapiens
  misc_feature: GZ8MTXP02IU5U4.3.12.B01.1.454.CMB.2.raw
  modified_base (361)..(361): a, c, t, g, unknown or other
  misc_feature (361)..(361): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggcctcctcatctatgatgcatccacgacgggcccaccggtatccccagcccaggttcagtggcaggtgggtctggggacnggtagttcactctcaccatcagcacgctgcagtctgagtatttgctagtttatactgtcagtctattacaataactggacctcggctcgtacgttcgggacggacgggtaccaagggtggaagacgtacgaaaacgtacgtggtcggactcgaccaccgtatcttcg

SEQ ID NO: 321387 - DNA, 549 bp, Homo sapiens
  misc_feature: GZ8MTXP02HQPBO.3.12.B01.1.454.CMB.2.raw
  modified_base (288)..(288): a, c, t, g, unknown or other
  misc_feature (288)..(288): n is a, c, g, or t
  modified_base (361)..(361): a, c, t, g, unknown or other
  misc_feature (361)..(361): n is a, c, g, or t
  modified_base (396)..(396): a, c, t, g, unknown or other
  misc_feature (396)..(396): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggcctccncatctatgatgcatccacgacgggcccaccggtatcccagccaggttcagtggcaggtcggggtctggggacnggtacgttcacttcctcaccatccagcacgctgcngtctgagtatttgactagtttatttactgtctagtactattaaccaaattaactggacctcggctacgtacgtttcgggacgggtacgggtaccgaagggtggaagtacgtaacgaaacgtaagtggtacggctacgctaacctattacttcg

SEQ ID NO: 321388 - DNA, 548 bp, Homo sapiens
  misc_feature: GZ8MTXP02GPTCH.3.12.B01.1.454.CMB.2.raw
  modified_base (360)..(360): a, c, t, g, unknown or other
  misc_feature (360)..(360): n is a, c, g, or t
  modified_base (394)..(394): a, c, t, g, unknown or other
  misc_feature (394)..(394): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggcctcctcatctatgatgcatccaccgagggcccaccggtatccccagccaggttcagtgcaggtcgggtctggggacnggagttcactctcaccatcagcagcctgcagtcngagtatttgctagtttattactgtcagtctaattaacaataactcggcctcggctctacgtttcgggacggacgggaccgtaagggtggaacgtacgtaaccgaaaacggtaacgtggttacggacgttacggacctaacgtacttccgttacg

SEQ ID NO: 321389 - DNA, 518 bp, Homo sapiens
  misc_feature: GZ8MTXP02H6THQ.3.12.B01.1.454.CMB.2.raw
  modified_base (198)..(198): a, c, t, g, unknown or other
  misc_feature (198)..(198): n is a, c, g, or t
  modified_base (320)..(320): a, c, t, g, unknown or other
  misc_feature (320)..(320): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctccagatgccactggagaaatggggttgacgcagtttccagccaccctgtctgtgtctccgagggganagagccaccctctcctgcagggccagtcagagtgttgacagcaacttggcctggtaccagcagcaacctggccaggcctcccaggcctcctcatctatgatgcatccacaggccaccggtancccagccaggtcagtgcagtgggtcngggacngagttcactcncacatcagcagcctgcagtcngagtatttgctagtttatactgtctagctaattacaataacgtcgtcctcggactcgtacgtttcggacggaacgggaccgaaggtaggacgacgtaacgaaacgtacgtgtggacgtcgaccacactacgtcg

SEQ ID NO: 321390 - DNA, 548 bp, Homo sapiens
  misc_feature: GZ8MTXP02I3ZOC.3.12.B01.1.454.CMB.2.raw
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
  modified_base (322)..(322): a, c, t, g, unknown or other
  misc_feature (322)..(322): n is a, c, g, or t
  modified_base (364)..(364): a, c, t, g, unknown or other
  misc_feature (364)..(364): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtatccaggggagagagcccaccctctcctgcagggccagtcagagtgttgacagcaacttggcctggtaccagcagcaactggccaggctcccaggcctcctnatctangatgcatccacgngggcccacggtacnccccagcctaggttccaggtggcaggtcgggtctaggggacngggtcttccaccttcctacaacctatccagcacgcctgctagtctggtaggttatttgacttagtttattacgtgtcagtactaattaacaataacgtcgtcgtacgctacgtacgttcggacggacggacgaagggtgaacgactaacgaacgtaacgtgtacggactcgactactctcttcg

SEQ ID NO: 321391 - DNA, 552 bp, Homo sapiens
  misc_feature: GZ8MTXP02GUZRR.3.12.B01.1.454.CMB.2.raw
  modified_base (325)..(325): a, c, t, g, unknown or other
  misc_feature (325)..(325): n is a, c, g, or t
  modified_base (363)..(363): a, c, t, g, unknown or other
  misc_feature (363)..(363): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggcctcccaggcctcctcatctatgatgcatcccacgagggcccaccggtancccagccaggttcaggtggctaggtgggtctggggacnggtagttcactcctacaccatcagcagcctgcagtctgtagtatttgacttagtttattactgtcagtctaattaacaaataacgtcggtcctcggtcctcgtacgtttcgggacgggtacgggaccgaagggtaggaacgacgtaacgaaaacgtaacgtggtacggctacgacaccgtactcgttcg

SEQ ID NO: 321392 - DNA, 654 bp, Homo sapiens
  misc_feature: GZ8MTXP02IIALN.3.12.B01.1.454.CMB.2.raw
  modified_base (328)..(328): a, c, t, g, unknown or other
  misc_feature (328)..(328): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaactggccaggcctcccgaggcctcctcatctatgatgcactccaccgacgggcccaccggtacnccccgagccctaggttcaggtcggcaggtcggggtctggggaactgggtacgtttaccaccttcctacccaaccctatccaacgcaacgtcccgtgacagttccgtaggtaacggttatttttggacttaagttttaactttacgttgttacgtagtactaacttaaactaaacttaaacgtcggtaccgttccggtcttaccgtaccggtttacggggaccgggtaacggggtaaccgtaaacggggtaggaaacgtaacgtaaaccgaaaacggtaaaccgtgggttacggaccttacggaacctaccgttaacgttactttcg

SEQ ID NO: 321393 - DNA, 531 bp, Homo sapiens
  misc_feature: GZ8MTXP02F45U6.3.12.B01.1.454.CMB.2.raw
  modified_base (288)..(288): a, c, t, g, unknown or other
  misc_feature (288)..(288): n is a, c, g, or t
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
  modified_base (395)..(395): a, c, t, g, unknown or other
  misc_feature (395)..(395): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctnatctatgatgcatccaccagggcccaccggtatcccagccaggttcagtggcaggtgggtctgggacnggngttcactctcaacatcagcagcctgcagtctgagtntttgactagtttatactgtcagctaattaacaaattaacgtgtacctcggctctacgttcgggacggtacgggaccgtaagggtaggaacgtacgtacgaaaacgaacgtgtacggactacgacacctatcttacg

SEQ ID NO: 321394 - DNA, 617 bp, Homo sapiens
  misc_feature: GZ8MTXP02J5B67.3.12.B01.1.454.CMB.2.raw
  modified_base (314)..(314): a, c, t, g, unknown or other
  misc_feature (314)..(314): n is a, c, g, or t
  modified_base (335)..(335): a, c, t, g, unknown or other
  misc_feature (335)..(335): n is a, c, g, or t
tcagagacgcactccacgaccggtgctcgatttagtagtgtagattccggcggggtaggaactgctcagttaggacccagacggaaccatggaagccccagcgcagcttctcttcctcctgctactctggctcccagatgccactggagaaatgggttgacgcagtttccagccaccctgtctgtgtctccgagggagagacgccaccctctcctgcagggccagtcagagtgtgacagcaacttggcctggtaccagcagcaacctggccaggctcccaggctcctcatctagtgatcgcactcccgaaccgnggacccgaccggtactacccncgacgtcggttacggcggtcggcgtaggtcggttcggtacggtacgagttacgtacctacctcctaccaccacgtacacgacgacgcgtcgtcgtacgtacgtaggtaggttagtttacgtttacgttacgtttacgtttacttacgttacgtacgtactactaactactaacgtacgtaccgtccggtccgtccgtcgtacgtacggtacggtacggtacggtacggacgtacgtacgtacgaacgtaacgtacgtacgtacgtacgtacgtacgtactcg

SEQ ID NO: 321395 - DNA, 597 bp, Homo sapiens
  misc_feature: GZ8MTXP02F4UWP.3.12.B01.1.454.CMB.2.raw
  modified_base (198)..(198): a, c, t, g, unknown or other
  misc_feature (198)..(198): n is a, c, g, or t
  modified_base (363)..(363): a, c, t, g, unknown or other
  misc_feature (363)..(363): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgttgacagcaacttggcctggtaccagcagcaactggccaggctcccagcctcctcatctatgatgcatcccaccgacgggcccaccggtactccccagccaggttcagtcggcaggtcgggtctggggacnggtagttcacgtctcacatcagctacgcctgcgtagtcgtggtaggtatttggacttagtttattactgtactagtactaattaactaaacttaacgtcggtacccgtcggtcttaccgtacggtttccgggaccggggacggggtaacccggtaaagggtacgggaacgtaacgtaaaccgaaaacggtaaaccgtggtacggccgttacgaccgtacctacttacgtttccg

SEQ ID NO: 321396 - DNA, 544 bp, Homo sapiens
  misc_feature: GZ8MTXP02JKZRH.3.12.B01.1.454.CMB.2.raw
  modified_base (287)..(287): a, c, t, g, unknown or other
  misc_feature (287)..(287): n is a, c, g, or t
  modified_base (358)..(358): a, c, t, g, unknown or other
  misc_feature (358)..(358): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgtgacagcaacttggcctggtaccagcagcaactggccaggctcccaggcctcctnatctatgatgcatccaccagggcccaccggtatccccagcccaggttcaggtggcagtgggtctggggacnggagttcacgtctcaccatcagcagcctgcagtctgaggtatttgacttagtttattactgtcagtactattaacaataacgtcggtcctcggcttacgtacgtttcgggacgggtagggaccgtaaagggtcggaagtacgtacgaaaacggtaactggtacggctacggacacctagtcttacg

SEQ ID NO: 321397 - DNA, 574 bp, Homo sapiens
  misc_feature: GZ8MTXP02JR1J5.3.12.B01.1.454.CMB.2.raw
  modified_base (365)..(365): a, c, t, g, unknown or other
  misc_feature (365)..(365): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggcctcccgaggcctcctcatctatgatgcatccaccgagggcccaccggtatccccagcccaggttccaggtggcaggtgggtctggggacnggtagttcactctcacatcagcagcctgcagtctgaggttatttgcttagtttatactgtcagtctacttaacaaattacgtcggtccgtcggcttacgtaccgtttcgggaccgggtaacggggtaaccgtaaggggtcgggaacgtaacttaaccgaaaacggtaaccgttggtacggtcgtacggacctaccgtactaccgtttcg

SEQ ID NO: 321398 - DNA, 705 bp, Homo sapiens
  misc_feature: GZ8MTXP02GJL9P.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagacgccaccctctcctgcagggccagtcagagtgttgacagcaacttggcctggtaccagcagcaacctggccaggcctcccaggcctcctcatctatgatgcactccaccgacgggcccaaccggtactccccgaagtcctaggttccaggtacggctaggggttcggggtacgtaggggaacagggtacgtttaccacttcccgtacaaccagttccaacgccaacgcccgtacgcgtagtacgtaggtacggttaatttttcggactttaagttttaacgtttaacgttcggttactaacggtacttaaacgtttaaacctaaacgttaaaccgttccgggtacccgttccggggtacctttaccgttaaacccgggttttccggggaccggggtaacgggggtaaacccggtaaaggggttaacggaacggtaacgttaaaaccgaaaacggttaacgtcgggtacggtacgttacggactaacccggtacttacgtttccg

SEQ ID NO: 321399 - DNA, 578 bp, Homo sapiens
  misc_feature: GZ8MTXP02JJOVN.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagcccaccctctcctgcagggccagtcagagtgtgacagcaacttggcctggtaccagcagcaacctggccaggctcccgaggcctcctcatctatgatgcatccaccgagggcccaccggtactcccgagccgaggttccaggtcggactaggtcgggtctaggggactggtacgttcactcctacaccatcagctacgcctgcagtctaggtagtatttgacttagttttactacgttgtactagtactaatttaacaattaacgtcggtacctcggtctacgtacgttcggggacggacgggaaccgaagggtcggaacgtacgtaacgaaaaccgagttaaggcggtactcggacccaacgtcttacgttacg

SEQ ID NO: 321400 - DNA, 554 bp, Homo sapiens
  misc_feature: GZ8MTXP02GXWBF.3.12.B01.1.454.CMB.2.raw
  modified_base (290)..(290): a, c, t, g, unknown or other
  misc_feature (290)..(290): n is a, c, g, or t
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagcccaccctctcctgcagggccagtcagagtgttgacagcaacttggcctggtaccagcagcaacctggccaggcctcccaggcctccncatctatgatgcatcccaccgagggcccaccggtactccccgagcccgtaaggttcaggtcggctagggtcggggtctggggacnggtcgttcactctcacntcagcagctgcagtctgagtatttgcttagtttatactgtctagctaattaacagtaacgtcgtacctcggtctcgtacgttcgggacggtacgggaccgtaagggtcggaacgtacgtacgaaacggtacgtggtcggacgtacgaccacgtactcgttcg

SEQ ID NO: 321401 - DNA, 594 bp, Homo sapiens
  misc_feature: GZ8MTXP02JA79Y.3.12.B01.1.454.CMB.2.raw
  modified_base (198)..(198): a, c, t, g, unknown or other
  misc_feature (198)..(198): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccgagggganagagccaccctctcctgcagggccagtcagagtgtgacagcaacttggcctggtaccagcagcaacctggccaggcctcccagctcctcatctatgatgcactcccacgcgggcccaccggtactcccagccaggttcaggtcgctaggtgggtctaggggacagggtagtttccacgttcctacaaccctatccaagcaacgtccctaggcctagtcgtaggtaggttacttttagacttagtttacttacgtgtactagtactattaacaattaacgtcggtacctcgacttacgtacgttccgggacgggtaacggaccgaagggtacggaacgtacgtaaaccggaaacgtaacgtgggtacggacgttacggcctaaccgtattcgttacg

SEQ ID NO: 321402 - DNA, 584 bp, Homo sapiens
  misc_feature: GZ8MTXP02GBTAS.3.12.B01.1.454.CMB.2.raw
  modified_base (200)..(200): a, c, t, g, unknown or other
  misc_feature (200)..(200): n is a, c, g, or t
  modified_base (242)..(242): a, c, t, g, unknown or other
  misc_feature (242)..(242): n is a, c, g, or t
  modified_base (397)..(397): a, c, t, g, unknown or other
  misc_feature (397)..(397): n is a, c, g, or t
  modified_base (577)..(577): a, c, t, g, unknown or other
  misc_feature (577)..(577): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgcagtttccagccaccctgtctgtgtctccgagggganagacgccaccctctcctgcacgggccagtcagagtgttgacngcaacttggcctggtaccagcagcaaccgtggccaggcctcccgaggtcctcctcatctatgatgcactcccaccgacgggcccaccggtactccccagccctaggttccaaggtcggctagggtgggtctaggggactggtacgttcaccttcnccacagtccagcacgctgctagtctggtagtactttgacttagtttattctgtctagacctaagttaactaacgtaacgtcgtccgttcggccttacgtaccggtttacgggacgggtaacggtaccgtaaggggtagacggtaactaacgaacgtaagtcgttacggcacgaccactcncgtttcg

SEQ ID NO: 321403 - DNA, 632 bp, Homo sapiens
  misc_feature: GZ8MTXP02F539M.3.12.B01.1.454.CMB.2.raw
  modified_base (383)..(383): a, c, t, g, unknown or other
  misc_feature (383)..(383): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgcagtttccagccaccctgtctgtgtctccgaggggagagacgccaccctctcctgcgacgggccagtcagagttgttgacagctaacgttggcctggtaccagcagaccaacctggccacgggcctacccaggtcctcctacatctatgatgcactccaccgacgggacccaccggtactccccgagcctaggttcacggtggcaggtgggtcgtggacnggtacgttcactcctaccaactataccagcacgcctcgactacgtctaggtacggttattttggacttaggttttaattaccgttggtactagtactaactttaaactaacgttaaaccgtcggtacccgtcggccttacgttaccggtttccgggacggggacgggaaccgtaacggggtaggaacgtaacgttaaaccgaaaccggtaagttcggtacggtacgttacgaccgaactactcgtttcg

SEQ ID NO: 321404 - DNA, 511 bp, Homo sapiens
  misc_feature: GZ8MTXP02HIQZM.3.12.B01.1.454.CMB.2.raw
  modified_base (200)..(200): a, c, t, g, unknown or other
  misc_feature (200)..(200): n is a, c, g, or t
  modified_base (358)..(358): a, c, t, g, unknown or other
  misc_feature (358)..(358): n is a, c, g, or t
  modified_base (397)..(397): a, c, t, g, unknown or other
  misc_feature (397)..(397): n is a, c, g, or t
  modified_base (429)..(429): a, c, t, g, unknown or other
  misc_feature (429)..(429): n is a, c, g, or t
  modified_base (507)..(507): a, c, t, g, unknown or other
  misc_feature (507)..(507): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagataccactgcacaaatagtgatgacgcagtctccagccaccctgtctgtttctccaggggaacngtctccctctcctgcagggccagtcagagtgtacaacaacaacttagcctggtatcaacagaaacctggccaggctcccgaggctcctcatctatgattgtgtcttcgtcgggtcacgttggtcctcccgaggctaggttcagtcggcagtggatcgngggacagtaacttcacgctcacatcatcaggctggcgtntgacgtacttcgctagtcttattctgtacaangtacgatcggccgctcggtgactgtcggactaaggtaccagggtcgacacgtcgaagacgatggacgctcgacacctntctg

SEQ ID NO: 321405 - DNA, 689 bp, Homo sapiens
  misc_feature: GZ8MTXP02H8I80.3.12.B01.1.454.CMB.2.raw
  modified_base (281)..(281): a, c, t, g, unknown or other
  misc_feature (281)..(281): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (353)..(353): a, c, t, g, unknown or other
  misc_feature (353)..(353): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagcccacccctctcctgcagggccagtcagtagtgttgacagtcaacgttcggcctggtaccagcagcactggcaggccnccagcctcctcatntatnatcgacactcccaccggacggacccacggtacacccgacgtaccgtaggttccnggtcggcgtagggtcggggtcgtagggactggtacgttacaccgtcctaccacccgataccgaacgtccaacggtcccttaggacctgggttaccgtaggggtaacgttttacgttttcgggtacttaagtttttactacgttcggtaactacgttactaaactttaaacgaaacttaccggtacgggtccctacgggtcccttaccgttaacgggttcccgggggaacgggtaaccgggtaaccggtaagggggttacgaaacgtaacgtaaccgttaaaacggaccggtttggtacccggacttacggaaccttaccgtatttaccgtttccgg

SEQ ID NO: 321406 - DNA, 731 bp, Homo sapiens
  misc_feature: GZ8MTXP02GYAU1.3.12.B01.1.454.CMB.2.raw
  modified_base (199)..(199): a, c, t, g, unknown or other
  misc_feature (199)..(199): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgttgacagcaacttggcctggtaccagcagcaactggccaggcctcccaggctcctcatcgtatgatgacactcccaaccgacggggcccctaaccgggtactcccccgaaggtccccgaaaggggtttccaacggggttcggaccgtaaggggttcgggggtccttgggggaaacctaggggtacgtttaccaaccttccgtaccaacccattcccgaaagccaacggtcccctaggccctaaggttccgtaggagggtttactttttgggaccttaagtttttacgtttaacctggtttaccaaggtaccttaaatttaaccctaaaagttaaacccgttcggggtacctttccgggcctttacccgtaaaccgttttccgggggacgggaaacggggttaccgaaaagggggttcggaaagtacgttaaaccgaaaaaccggttaacgtgggttaacgggaccttcggaaccgtaaaccctaggttacgtttaccg

SEQ ID NO: 321407 - DNA, 573 bp, Homo sapiens
  misc_feature: GZ8MTXP02GTPUB.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggcctcccaggcctcctcatctatgatgcactccaccgagggcccaccggtactccccagcccaggttcaggtcggctaggtcgggtctggggacaggtacgttcaccttccgtaccaccatccagcacgcctgcagtctgtagtatttgacttagtttattacgtgtactagtactattaactaaattaacgtcggtcctacggtccttacgtacgtttcggggacggtacgggaccgtaagggtggaacgtacgtaacgaaacgtacgtggtacggtacgtcgaccactacgttctcg

SEQ ID NO: 321408 - DNA, 639 bp, Homo sapiens
  misc_feature: GZ8MTXP02IMNZZ.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagctaacttggcctggtaccagcagcaactggaccaggcctcccaggcctcctcatctatgatgacactccaacgacggccccaccggtactccccgagccctaaggttccaggtcggacgtagggttcggggtcgtaggggaacctaggggtaccgtttccaaccgttccctacccgaacctaactccgaacgcacggtcctacgcgtaagttcgtaggtagttattttacggacttagttttattacgttgtactacgtactaattaaaccaacgttaacgtcggtccgttacggtccttacgtaccggtttacgggacgggtaacgggtacgtaacggggtaggaacgtacgtaaccgaaagtacgtggtacgcgtacgaccaccttacgtcgttacg

SEQ ID NO: 321409 - DNA, 588 bp, Homo sapiens
  misc_feature: GZ8MTXP02JPZT3.3.12.B01.1.454.CMB.2.raw
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
tcagagacgcactccacgaccggtgctcgatttagtagtgtagattcgtgggctggtggagtctgggggaggcttggtccagcctggggggtccctgagactctcctgtgcagcctctggattcagctttagtaccaattggatgaactgggtccgccaggctccagggaagggctggagtggctggcccacataaacccagatggaacttattcacactatgtggactctgtgagggccgattcaccatctccagagacaaccccaagaactcactgttcngacaatggacagcctgagngccgaggacacggctgtatattactgtgcgagagtanagtgaagaaactcaatgaatagaaatcgaaggggagtgggggaccaggggaccctggtccaccgtctcctcacgccctccaccgaacggcccagtcccgttccctccccgtcggcccgcccgtcgccctaccgacggcgccgacccgtccgagacgccgaacgccggccggtcccggcgggtcctcggtcccgtacggtacgaaacggaaccgttaccgtttaccggacgttcgccgttcgtcgtacggg

SEQ ID NO: 321410 - DNA, 626 bp, Homo sapiens
  misc_feature: GZ8MTXP02H1CIU.3.12.B01.1.454.CMB.2.raw
  modified_base (380)..(380): a, c, t, g, unknown or other
  misc_feature (380)..(380): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacgttggcctggtaccagcagcaacctggccaggctcccaggcctcctcatctatgatgcatcccaccgacggggcccaaccggtactccccgagcccgtaggttccaggtggccgtagggttcggggtcgtggggacngggtacgtttcaccgttcctaccaccatccacgcacgggggcctgcagttcgtaggtaggttagtttgtacgttagtttatttacgttgtctacgtactaattaactaaacgttaacgtacggtccgtcgtaccgttcgtacgtttcgggtacgggtacgggtaaccggtaagggtacgggtaaagtacgtaacgtaaaacgtaacgtaacggtacggtacgtacgaccaccgtacgttacgttcg

SEQ ID NO: 321411 - DNA, 686 bp, Homo sapiens
  misc_feature: GZ8MTXP02HA75S.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagcccaccctctcctgcagggccagtcagagtgtgacagcaacttggcctggtaccagcagcaactggccaggcctcccgaggcctcctcatctatgatgcatcccaccgacgggcccaccggtactccccgagcctaggttccaggtcggctaggtcgggtcgtaggggactaggtacgttcaccgttcctaccaacctataccgaacgccaacggtccctggacctaagttccgtagggtaagggtttatttttcggaccgttaaggtttttaacttaccgtttaggttacctaaggtaccttaaatttaaacctaaaacgttaaaccgtcgggtacccttaccgggtcccttaccgttaccggtttacccggggacggggtaaaacgggtacccggtaaaggggtacggaaacggtaactaaaccggaaaaccgtaacggttggtacggtaccgtacggacctaaaccgtcttaccgtttcg

SEQ ID NO: 321412 - DNA, 552 bp, Homo sapiens
  misc_feature: GZ8MTXP02IEQ0D.3.12.B01.1.454.CMB.2.raw
  modified_base (193)..(193): a, c, t, g, unknown or other
  misc_feature (193)..(193): n is a, c, g, or t
  modified_base (464)..(464): a, c, t, g, unknown or other
  misc_feature (464)..(464): n is a, c, g, or t
tcagagacgcactccacgaccggtgctcgatttagtagtgtagattcgtgggctggtggagtctgggggaggcttggtccagcctggggggtccctgagactctcctgtgcagcctctggattcagctttagtaccaattggatgaactgggtccgccaggctccagggaaggggctggagtggctggcccanataaacccagatggaacttatcacactatgtggactctgtgaggggccattcaccatctccagagacaacccaagaactcactgttctgcaaatggacagcctgagagccgaggacacggctagtatattactgtgcgagagatatagaagaactcaaatgatagaaatcgaggggatggggggacaggggaaccctggtccaccggtctcctcacgcctaccaccaacgggcccatcggtacccttcccccgtggccgcctcgcctccgngacgctaccctccgagacgcaacgcgccggtccctggcctcgccctggtaccaaggaactccgttaccgagtcgtccgtcttcgacgg

SEQ ID NO: 321413 - DNA, 542 bp, Homo sapiens
  misc_feature: GZ8MTXP02I3NMH.3.12.B01.1.454.CMB.2.raw
  modified_base (289)..(289): a, c, t, g, unknown or other
  misc_feature (289)..(289): n is a, c, g, or t
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggcctcccaggctcctnatctatgatgcatccaccagggcccaccggtancccagccaggtcagtggcaggtgggtcngggacagngttcactctcaccntcagcagcctgcagtctaggagtatttgactagtttattactgtacagtctaacttaacaaattaacgtggccctcggcttcgtacgttcgggacggagggaccgaaagggtggaagtacgtaacgaaacgtaacgtggtacggacgtacggaccaccgtacgtcttacg

SEQ ID NO: 321414 - DNA, 505 bp, Homo sapiens
  misc_feature: GZ8MTXP02ITOCX.3.12.B01.1.454.CMB.2.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
  modified_base (354)..(354): a, c, t, g, unknown or other
  misc_feature (354)..(354): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccagggganagagccaccctctcctgcagggccagtcagagtgtgacagcaacttggcctggtaccagcagcaacctggccaggctcccaggcctccncatctatgatgcatccaccgagggcccaccggtatccccagccaggttcagtgcagtggtctgggacngattcactctcacatcagcagcctgcagtctgagtatttgctagtttatactgctagctatacaatactgcctggctctacgttcgggacggtaggacctaggtaggagacgtaacgaaaacgtagttgcggactcgactacctatcttcg

SEQ ID NO: 321415 - DNA, 591 bp, Homo sapiens
  misc_feature: GZ8MTXP02G5LXO.3.12.B01.1.454.CMB.2.raw
  modified_base (326)..(326): a, c, t, g, unknown or other
  misc_feature (326)..(326): n is a, c, g, or t
  modified_base (368)..(368): a, c, t, g, unknown or other
  misc_feature (368)..(368): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgtgacagcaacttggcctggtaccagcagcaacctggccaggcctcccgaggcctcctcatctatgatgcactcccaccgacggcccaccggtanccccgagcccgaggttcaggtggctaggtgggtctggggacnggtcgttcacctctacaccatcacgcacgcctgcagtcgtggtagttattttgacttaagttttacttacgtgtaccgtagtacttaattaactaaagttaaccgtcggtccgtaccgtcgtacgtaccgtttacgggacgggtacgggaaccgtaaagggtaggaaacgtaacgtaccgaaaacgtagtcggtacgtacgtacgactacctacttcgttacg

SEQ ID NO: 321416 - DNA, 612 bp, Homo sapiens
  misc_feature: GZ8MTXP02HRHOK.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggcctcccaggcctcctcatctatgatgcatccaccgagggcccaccggtactccccagccctaggttcaggtcggctaggttcggggtcgtggggaacaggtacgtttccacgttcctaccacctatccagcacgcctgcctagtcgtaggtaggttattttgacttagtttatttaccgtgttcgagtactaattaaccaaagttaacgtcggtacccttcggtaccttaccgtacggtttccggggacggggtaacggggtaaccgtaaaggggtcgggtaagacgttaaccgaaaacgtaacgtggtacggtctacggacctaaccagtttcctcg

SEQ ID NO: 321417 - DNA, 513 bp, Homo sapiens
  misc_feature: GZ8MTXP02GATF5.3.12.B01.1.454.CMB.2.raw
  modified_base (357)..(357): a, c, t, g, unknown or other
  misc_feature (357)..(357): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggcctcctcatctatgatgcatccacagggcccaccggtatccccagccaggttcagtgcaggtgggtctggggacnggacttcactctcaccatcagcagcctgcagtctgaggtatttgctagtttattactgtcagctattacaataacgtcgacctcggctacgtacgttcggacggtacggaccgaaggtggacgactacgaacgagtgtgactcgacacgactctcg

SEQ ID NO: 321418 - DNA, 533 bp, Homo sapiens
  misc_feature: GZ8MTXP02J2I3J.3.12.B01.1.454.CMB.2.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (390)..(390): a, c, t, g, unknown or other
  misc_feature (390)..(390): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgtgacagcaacttggcctggtaccagcagcaactggccagctcccagctcctnatctatgatgcatccacgngggcccacggtncccagcctaggtcagtggcagtgggtcngggacngngttcactctccaccatcagcagcctgcagtctggtagtnttttgcttagtttattacttgtactagtactaatttaacgaaattacgtcggccgttcggcttcgtacgttcggacggagggaccgaagggtgacgtacaacgaaacgtaacgtggtacggctacggacctaccgtatcttcg

SEQ ID NO: 321419 - DNA, 555 bp, Homo sapiens
  misc_feature: GZ8MTXP02HQADE.3.12.B01.1.454.CMB.2.raw
  modified_base (295)..(295): a, c, t, g, unknown or other
  misc_feature (295)..(295): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcaggccagtcagagtgttgacagcaacttggcctggtaccagcagcaacctggccaggctcccaggctcctcatctatgntgcatccaccagggccaccggtatcccagccagttcagtggcagtgggtncgggangtattcactcctacacatcngcagccctgcagtctgagtacttttgctagtttattacctgttactagtctaattaactaataaacgttcggaccgttcggctcgtaacgtttcgggtacggaacggggtacctaaacggggtggaacgtacgtacgtaaaaccgagttaacggtaggacttacgactaccacgttctttaccg

SEQ ID NO: 321420 - DNA, 601 bp, Homo sapiens
  misc_feature: GZ8MTXP02FW6NC.3.12.B01.1.454.CMB.2.raw
  modified_base (297)..(297): a, c, t, g, unknown or other
  misc_feature (297)..(297): n is a, c, g, or t
  modified_base (368)..(368): a, c, t, g, unknown or other
  misc_feature (368)..(368): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcagggccagtcagagtgtgacagcaacttggcctggtaccagcagcaacctggccaggcctcccgagcctcctcatctangatgcactccacgacggcccaccggtactccccagcctaggttccaggtcggctaggtcgggtctgggacnggtcgtcactctaccacatcagcacgcctgctagtctgagttatttgacttagtttactactgtaccagtacctaatttaaacaaacgttacgtcggtacccgttcggtaccttaccgtaccgggtttccggggacggggtaacgggtaaccgtaagggggttacgaaacgtacgttaaaccgaaaacggtaacgtgggtacggactacggaccgttaccacgttcctttacg

SEQ ID NO: 321421 - DNA, 568 bp, Homo sapiens
  misc_feature: GZ8MTXP02JZMEG.3.12.B01.1.454.CMB.2.raw
  modified_base (329)..(329): a, c, t, g, unknown or other
  misc_feature (329)..(329): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgtgacagcaacttggcctggtaccagcagcaaccgtggccaggcctcccgaggcctcctcatctatgatgcactcccaccgacgggcccaccggtacnccccagccaggttcacggtggctaggtcggggtctggggacagggtcgttcaccgttctaccacccatccagccagtccctgcagtctggtaggttatttgacttagtttattactgtcagtctaattacaatacgtcggcctcggctcgtacgttcgggacggaacgggtaccgaaggggtaggacgaacgtaccgaaaacgtacgtggtcggactacggaccacgtacttccgtacg

SEQ ID NO: 321422 - DNA, 574 bp, Homo sapiens
  misc_feature: GZ8MTXP02GWVLE.3.12.B01.1.454.CMB.2.raw
  modified_base (369)..(369): a, c, t, g, unknown or other
  misc_feature (369)..(369): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggcctcctcatctatgatgcatccaccgacgggcccaccggtactccccgagccgaggttcacggtggctaggtcggggtctggggacnggtagttcactctccacatcagcagcctgcagtctgagtatttgcttagtttattactgtcagtactattaacaaattaacgtcggtacctcggtcctacgtacgtttcgggacgggtacgggtaccgaaaggggtcggaacgtaacgtaccgaaaacggtaacgtcggtacggtacgttacggacctaacctagtaccgtttcg

SEQ ID NO: 321423 - DNA, 592 bp, Homo sapiens
  misc_feature: GZ8MTXP02FNXTM.3.12.B01.1.454.CMB.2.raw
  modified_base (198)..(198): a, c, t, g, unknown or other
  misc_feature (198)..(198): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgttgacagctaacttggcctggtaccagcagcaacctggccaggcctcccgaggcctcctcatctatgatgcactcccaccgacgggcccaccggtactccccgagccgtaaggttcacggtggccgtagggtggggtacgtggggactggtacgttccaacttcctacaaccgtatcacgcacgcctgctagtcgtaggtaggttatttgacttagttttatacgtgtacagtactaattaactaatacgtcgtccgtcggtaccttacgtacgtttcgggacggtaacgggaccgtaaagggtaggacgtacgtaaacgaaccggtaagtggtcggactcggaccactacgtctttccg

SEQ ID NO: 321424 - DNA, 522 bp, Homo sapiens
  misc_feature: GZ8MTXP02GDW72.3.12.B01.1.454.CMB.2.raw
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggcctcccaggcctcctcatctatgatgcatccaccgagggcccaccggtactcccagccaggttcaggtggcaggtgggtctgggacngngttcactcncacntcancagctgcagtctgagtatttgactagtttattactgtcagtactattaacaataacgtggtcctacggctctacgttcgggacggacgggaccgaaggtcggagactacgaaacgacgtgtcggactcgacacatcgtacg

SEQ ID NO: 321425 - DNA, 609 bp, Homo sapiens
  misc_feature: GZ8MTXP02HC8YG.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagttccagccaccctgtctgtgtctccgaggggagagagccaccctctcctgcagggccagtcagagtgttgacagcaacttggcctggtaccagcagcaaccgtggccaggcctcccgaggcctcctcatctatgatgacactcccacgacgggcccaccggtactccccagcctaggttcaggtggcagggtcgggtcgtaggggacaggtacgttcaaccttcgtaccacctatccgacgcacgcctgactagtctggaggttatttgacttagtttacttactgtactagtacttataactaaagtaccgtcggtcctcggtaccttccgtacggtttaccggggacgggtaacgggtaccggtaagggtacggaacgtaacgtaaccgaaaacggtacgtggtacggtaccgtacggacctaaccgtacgttacgtttccg

SEQ ID NO: 321426 - DNA, 641 bp, Homo sapiens
  misc_feature: GZ8MTXP02FL1Q6.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggcctcccaggcctcctcatctatgatgcatcccaccgaggggacccaccggtactccccgagcctaggttccaggttcggcagggttcggggtcgtacggggacaggtacgttccaaccgtcctaccaacccatccaagccaacgccctagaccgtagttctaggtaggttattttcgacgttagttttaacttccgtgtaccagtacctaattaaacaaacgttaacgtcggtacccgttcggtaccttaccgttaacggtttccggggaacggggtaacggggaacccgtaaagggtgggaaacgtaacgtaaaccgaaaacggtaacgtggtacgggactacggacctaacgtactcgtttacg

SEQ ID NO: 321427 - DNA, 533 bp, Homo sapiens
  misc_feature: GZ8MTXP02IR5P3.3.12.B01.1.454.CMB.2.raw
  modified_base (199)..(199): a, c, t, g, unknown or other
  misc_feature (199)..(199): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgttgacagcaacttggcctggtaccagcagcaacctggccaggctcccaggctcctcatctatgatgcatccaccgagggcccaccggtatcccagccaggttcagtgcaggtggctgggacagtnttcactcncacatcagcagctgcagtcgtgagtagttgtatagttattactgtatagtactattaactaaataactacgtccgtcgtctactacgttcggtacggacggaaccggaacggtaggacgtacgtaacgaaacgaacgtaagtcggtacgtcgacgaccactacttcg

SEQ ID NO: 321428 - DNA, 575 bp, Homo sapiens
  misc_feature: GZ8MTXP02IA075.3.12.B01.1.454.CMB.2.raw
  modified_base (199)..(199): a, c, t, g, unknown or other
  misc_feature (199)..(199): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgtgacagcaacttggcctggtaccagcagcaacctggccaggcctcccgaggcctcctcatctatgatgcatccaccgagggcccacggtactccccgagcctaggttcagtgggactaggtcggggtctggggacaggtacgttcaccttctaccacatcagcacgcctgcagtctagtaggtatttgacttagtttaattcgtgtacagtactaattacaaacttaacgtcggtacctcggaccttccgtacggtttccgggacgggacgggtaccgaagggtacggaacgtacgtaaccgaaaacgtacgtggtacggcgtacgaccacctacttcgtcg

SEQ ID NO: 321429 - DNA, 511 bp, Homo sapiens
  misc_feature: GZ8MTXP02GLQVE.3.12.B01.1.454.CMB.2.raw
  modified_base (316)..(316): a, c, t, g, unknown or other
  misc_feature (316)..(316): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccaggggagagagccaccctctcctgcagggccagtcagagtgttgacagcaacttggcctggtaccagcagcaactggccaggctcccaggcctctcatctatgatgcatccacaggcccacggtancccagccaggtcagtgcagtgggtcngggacngnttcactcncacntcagcagctgcagtctgaggtatttgactagtttagttactgtcagctattaacaatacgtgacctcggctctacgtttcggcggtacgggaccgaagggtaggaagacgtaacgaaacgaacgtggtacgactacgacactactctcg

SEQ ID NO: 321430 - DNA, 569 bp, Homo sapiens
  misc_feature: GZ8MTXP02GI6X6.3.12.B01.1.454.CMB.2.raw
  modified_base (159)..(159): a, c, t, g, unknown or other
  misc_feature (159)..(159): n is a, c, g, or t
  modified_base (291)..(291): a, c, t, g, unknown or other
  misc_feature (291)..(291): n is a, c, g, or t
  modified_base (328)..(328): a, c, t, g, unknown or other
  misc_feature (328)..(328): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttnacgcagtttccagccaccctgtctgtgtctccgaggggagagagccaccctctcctgcagggccagtcagagtgtgacagcaacttggcctggtaccagcagcaacgtggccaggcctcccgaggcctcctnatctatgatcgcactcccacgacgggcccacggtacncccagcctaggtcaggtcggcaggtcgggtctggggacaggtagttccacttcctacaccatcagcacgctagcngtcngtacgtatttgactagtttattacgtgtctagtactattaacaacttaacgtcggtacctcggtctaccgtacgtttcgggacggtacgggaccgaagggtacggaacgacgtaacgaaacgtaacgtggtcggtacgtacgaccaacgtacttacgttccg

SEQ ID NO: 321431 - DNA, 591 bp, Homo sapiens
  misc_feature: GZ8MTXP02INU5F.3.12.B01.1.454.CMB.2.raw
  modified_base (296)..(296): a, c, t, g, unknown or other
  misc_feature (296)..(296): n is a, c, g, or t
  modified_base (332)..(332): a, c, t, g, unknown or other
  misc_feature (332)..(332): n is a, c, g, or t
  modified_base (423)..(423): a, c, t, g, unknown or other
  misc_feature (423)..(423): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactgggagaaatggggttgacgctagtttccagccaccctgtctgtgtctccgaggggagagacgcccaccctctcctgcgagggccagtcagagtgttgacagcaagttggcctggtaccagcagcaacctggccaggcctcccgaggcctccncatctatgatgcactccaccgacggccaccggtacncccgagcctaggttcaggtggctagggtggggtcgtaggggacaggtcgttcaccgttcctacaccatcacgcacgctgcagtcgtgagtntttgattagtttattactgtactagtactaagttaacaacgttacgtcggtacctcggtcttacgtacgttcgggacgggtaacgggtaccggtaaggtacgggtaaacgtacgtaaccgaaaacgtacgtaaggtcggtacgtacggactaccgtacgttcgttacg

SEQ ID NO: 321432 - DNA, 636 bp, Homo sapiens
  misc_feature: GZ8MTXP02I23MF.3.12.B01.1.454.CMB.2.raw
  modified_base (372)..(372): a, c, t, g, unknown or other
  misc_feature (372)..(372): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccgaggggagagagccaccctctcctgcagggccagtcagagtgttgacagcaacgttggcctggtaccagcagcaaccgtggccaggcctcccgaggcctcctcatctatgatgccatccgaccgacgggacccaccggtactcccgagccaggttcaggtggctaggtcgggtctagggacnggtcgttcactcctccaactagtcacgcacgtccgtgactacgtcgtaggtaggttgtttacgacgttaagtttttaacttaaccgtttggtactacggtaccgtagggtaccgtaaccgtacgtaaccgttcgggtaccctttcgttaccgttacgggtttaccgggaaccgggggtacgggtaaaccggtacggggtaggaacgtaacgtaaacgtaaaccggtaagtggtacggtacgtacgaccgtactacttcgtttcg

SEQ ID NO: 321433 - DNA, 578 bp, Homo sapiens
  misc_feature: GZ8MTXP02F081K.3.12.B01.1.454.CMB.2.raw
  modified_base (326)..(326): a, c, t, g, unknown or other
  misc_feature (326)..(326): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgtgacagcaacttggcctggtaccagcagcaacctggccaggcctcccgaggcctcctcatctatgatgcactccacgacgggcccacggtacnccccagcctaggttcaggtgcaggtgggtcngggacnggnttcactcncacatcagcagcctgctagtcgtggtaggttatttgacttagtttattacgtgtacagtactaattaacaactaacgtggtcccgtcggtcctacgtacgtttcggggacgggtaacggggtaccgtaaaggggtagggaacgtaacgtaacgaaaaccggtaagtcggtacggacgtacggacctaacctacgttcgtttacg

SEQ ID NO: 321434 - DNA, 579 bp, Homo sapiens
  misc_feature: GZ8MTXP02I37CT.3.12.B01.1.454.CMB.2.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
  modified_base (325)..(325): a, c, t, g, unknown or other
  misc_feature (325)..(325): n is a, c, g, or t
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgcagtttccagccaccctgtctgtgtctccgagggganagacgccaccctctcctgcagggccagtcagagtgtgacagcaacttggcctggtaccagcagcaactggccaggcctcccaggcctcctcatctangatgcactccacgacggcccacggtacncccagccaggtcagtcgcnggtggcagggacnggtattcacttccncaccancagcagccngcagtctgagttntttagacttagtttacttacgtgtactagtactaattaaactaaacgttacgtcgtacccgtcggtactaccgtacgttccggggacgggtaacgggggtaccgaaggggtacggaacgtacgtaaaaccgtaaaacggtaacgtcggtacggtcgtacgacctaacgtcgttacttccg

SEQ ID NO: 321435 - DNA, 516 bp, Homo sapiens
  misc_feature: GZ8MTXP02JR25J.3.12.B01.1.454.CMB.2.raw
  modified_base (197)..(197): a, c, t, g, unknown or other
  misc_feature (197)..(197): n is a, c, g, or t
  modified_base (317)..(317): a, c, t, g, unknown or other
  misc_feature (317)..(317): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
tcagagacgcactccacgaccggtgctcgatttagtagtgtagattccgcggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgtgacagcaacttggcctggtacccagcagcaacctggccaggctcccaggctcctcatctatgatgcatccacagggcccacggtntcccagccaggttcagtgcagtgggtcngggacngagttcactctcaccatcagcagcctgcagtctgagtatttgctagtttattactgtctagtctaattaacaagtaaactggtacctcggctacgtacgtttcggcggagggtaccagggtggacgatacgaaacgacgtgtcggactcggacaccagtacttcg

SEQ ID NO: 321436 - DNA, 582 bp, Homo sapiens
  misc_feature: GZ8MTXP02JRESN.3.12.B01.1.454.CMB.2.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (366)..(366): a, c, t, g, unknown or other
  misc_feature (366)..(366): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagcccaccctctcctgcagggccagtcagagtgttgacagcaacttggcctggtaccagcagcaacctggccaggcctcccnggctcctnatctatgatgcatcccacgacgggccctaccggtactcccagcctaggttcaggtggcaggtgggtcgtgggacnggtacgttcacctcgtacacctatccagcacgcctgctagtctggtagtatttcgacttagtttactacgttgtactagacttataacaaagttacgtcggtcctcgggtcttaccgtaacggttccgggacgggaacggggtaccgtaaaggggtggaacgtacgtaaccggaaaacgtacggtaagtcggtactcggacctacctgtacgttcg

SEQ ID NO: 321437 - DNA, 667 bp, Homo sapiens
  misc_feature: GZ8MTXP02H1X3Y.3.12.B01.1.454.CMB.2.raw
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (327)..(327): a, c, t, g, unknown or other
  misc_feature (327)..(327): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagtagtgttgacagcaagttggcctggaccagcagcaacctggccaggcncccaggcctcctnatctatgatgacactccacgacgggcccaccggtacncccgagccgtaggttcaggtggactagggtcgggtacgtaggggactggtacgttccaaccttcctaccaacctatcgacgccgaacgcctggactacgttcgtagggtaggttacttttcgacgttagtttttaacttacgttacggttactacgttaccttaagttaaaaccctaaagttaaacccgtcgggttaccccgtcgggttaacccttcgttaaccggttttcggggaacggggaacggggtaaccgtaaagggggttacgggaagtaaacgtaaaccgtaaaacggtacgtaacggggtacgtacgtacggacctaacctagtttacgtcg

SEQ ID NO: 321438 - DNA, 577 bp, Homo sapiens
  misc_feature: GZ8MTXP02GA637.3.12.B01.1.454.CMB.2.raw
  modified_base (362)..(362): a, c, t, g, unknown or other
  misc_feature (362)..(362): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggctcccaggcctcctcatctatgatgcatcccaccgagggcccaccggtatccccagccaggttcagtggcaggtgggtctggggacnggacgttcactctacacatccagcagcctgctagtctggaggtattttgacttagtttattacgtgtctagtactaattaacaaagttaacgtcggtccgttcggtcctacgtacgtttcgggacgggtaacgggaccgtaaagggtacggaacgtaacgtaaccgaaaacgtaacgttcggtacggacgtacggacctaaccgtactcgttacg

SEQ ID NO: 321439 - DNA, 605 bp, Homo sapiens
  misc_feature: GZ8MTXP02F9JDH.3.12.B01.1.454.CMB.2.raw
  modified_base (296)..(296): a, c, t, g, unknown or other
  misc_feature (296)..(296): n is a, c, g, or t
  modified_base (405)..(405): a, c, t, g, unknown or other
  misc_feature (405)..(405): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaactggccaggcctcccaggcctcctcatctangatgcatcccacagggcccaccggtactccccgagcctagggttcacggtcggcgacgggttggggtacgtaggggaccgagggtacgttccaacgttcctacaacctntacgaacgccaacgcccgtgcgtaagtcgtgtaggttatttcgacttagtttacttacgtgtacagtactattaactaactaacgtcgtccgtacggcttaccgtacgtttcgggacgggtaacgggtaccgtaaagggtcggaaagtacgtaaacgaaacggtaacgtggtacggacgtcgacctacgtacgttcttcg

SEQ ID NO: 321440 - DNA, 567 bp, Homo sapiens
  misc_feature: GZ8MTXP02FSHMO.3.12.B01.1.454.CMB.2.raw
  modified_base (368)..(368): a, c, t, g, unknown or other
  misc_feature (368)..(368): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgtgacagcaacttggcctggtaccagcagcaacctggccaggcctcccaggcctcctcatctatgatgcactccaccgacggggcccaccggtactccccgagcctagggttcaggtggcaggtgggtctggggacnggtacgttcactcctcacctatcagcacgcctgcagtctgaggtatttgacttagtttacttctgtacagtactattaacaacgttaacgtcggtaccctcggacttacgtacgtttcgggacggtacggggaacgtacgggtagacgtaacgtaaccgaaacgtacgtggtcggtactacggcctacacgttcttacg

SEQ ID NO: 321441 - DNA, 617 bp, Homo sapiens
  misc_feature: GZ8MTXP02HNN9I.3.12.B01.1.454.CMB.2.raw
  modified_base (198)..(198): a, c, t, g, unknown or other
  misc_feature (198)..(198): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgttgacagcaacttggcctggtaccagcagcaacctggccaggcctcccaggcctcctcatctatgatgcatcccaccgacgggcccaaccggtactcccccaagcccgtaacgggtttccaagggtcgggcgtagggttcggggtcgtaggggacctaggtacgtttacgaccttccaccacccgatccacgcacggtcctggctagtcgtaggtaggtgttttgacttaagttttatttacctttagagttactaattaacaattaacgtcggtaccgtcgtcttacgtacgtttacgggacgggtaacgggaccgtagggtacggagtaactacgaaaacggtacgtaggtcggacgtcgactacctacttccgttagtttcc

SEQ ID NO: 321442 - DNA, 570 bp, Homo sapiens
  misc_feature: GZ8MTXP02JTSIQ.3.12.B01.1.454.CMB.2.raw
  modified_base (199)..(199): a, c, t, g, unknown or other
  misc_feature (199)..(199): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgttgacagcaacttggcctggtaccagcagcaacctggccaggctcccaggctcctcatctatgatgcatccaccgagggcccaccggtatccccagcccaggttcaggtggcaggtcgggtctgggacnggtacgttcacgttcncacatcagcagccctgcagtctggagtagtttgacttaggtttattacctgtacagtactattaacaatacgtcggtacctacgtctacctacggtttcgggaccggggtacgggaccggtaaagggtacggaacgtacgtaacgaaacggtaaacgtggtcggtactcggacctaccgtacgttcgttacg

SEQ ID NO: 321443 - DNA, 647 bp, Homo sapiens
  misc_feature: GZ8MTXP02GQ59Q.3.12.B01.1.454.CMB.2.raw
  modified_base (199)..(199): a, c, t, g, unknown or other
  misc_feature (199)..(199): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgttgacagcaacttggcctggtaccagcagcaaccgtggccaggcctcccaggcctcctcatctatgatgcatcccaaccgacgggccccaacccggtactccccgaggtccctagggtttccagggttcggcgtagggttcggggtcgtggggaactagggtacgttccaaccgttcctaccaacccaatccaacgccacgtcctcggctaacgttcgtaggtaggttacgtttttgactttaagttttattacgttgtctaagtcttaactttaacaaacgttaaccgtcggtacccgttcggtccttacgttaccggtttccggggacgggtaacggggtaccgtaaggggttacggacgtacgtaccgaaacggtacgtggtcggtacgtcgaccgacgtcgttactttcg

SEQ ID NO: 321444 - DNA, 600 bp, Homo sapiens
  misc_feature: GZ8MTXP02I4QGE.3.12.B01.1.454.CMB.2.raw
  modified_base (199)..(199): a, c, t, g, unknown or other
  misc_feature (199)..(199): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgttgacagcaacttggcctggtaccagcagcaaccgtggccaggcctcccaggcctcctcatctatgatgcatcccaccgacgggcccaccggtactccccgagccctaggttccaggtcggctaggtcgggtctaggggacagggtcgttcacgttcctccaaccatccacgcgacgcctagctagtcgtgtaagttgttttgacgttagtttacttacgttgtactagtacttaattaactaactaacgtcggtcctacggtccttacgtacgtttcgggacgggacgggtaaccgaagggtacggagtaacgtaaccgtaaacgtaacgtcggtacggcgttacggaccgtacctattacgttcg

SEQ ID NO: 321445 - DNA, 578 bp, Homo sapiens
  misc_feature: GZ8MTXP02GZJOY.3.12.B01.1.454.CMB.2.raw
  modified_base (290)..(290): a, c, t, g, unknown or other
  misc_feature (290)..(290): n is a, c, g, or t
  modified_base (359)..(359): a, c, t, g, unknown or other
  misc_feature (359)..(359): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacgttggcctggtaccagcagcaacctggccaggctcccaggctcctnatctatgatgcatccacaggcccaccggtatcccagccaggttcacggtgctaggtcgggtctgggacngtaccttcactctcacatcagcagcctagacgcctagaatatttgacttagtttactacgtgtacagtcagtcgtagacctaacgtcggtccctcgttaccgtaccgttcgggaccgggtaacgggacccgtaaaggggtacgaacggtaacgtacccgtaaaacggacgttacggtaacggacctacggacctaaccgtacttacgttcgtttacccg

SEQ ID NO: 321446 - DNA, 708 bp, Homo sapiens
  misc_feature: GZ8MTXP02F1IBX.3.12.B01.1.454.CMB.2.raw
  modified_base (199)..(199): a, c, t, g, unknown or other
  misc_feature (199)..(199): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgttgacagctaacttggcctggtaccagcagcaacctggccaggcctcccaggcctcctcatctatgatgcactccaccgacgggcccaaccggtactccccagcccgtaggttcacggtcggctaggtcgggtcgtaggggaactgggtacgtttccacgttccctaccgaaccctaagtcccgaaacggccaacggtcccgttcggaccgtaacggttccgttagggtaagggtttacgtttttacggaccgtttaaggtttttaactttaacgttcggttaaccgtaacgttaccttaaaacgtttaaacctaaaacgttaaaccggtcggtaacccgttcgggtaccttaccggttaccggtttaccggggacggggtaaacggggtaaccggtaaaggggtacggtaacgtaaccgtaaacgaaacggtaacgtggtacggacgttacggaccgtactacgtaccgtttcg

SEQ ID NO: 321447 - DNA, 604 bp, Homo sapiens
  misc_feature: GZ8MTXP02IC094.3.12.B01.1.454.CMB.2.raw
  modified_base (198)..(198): a, c, t, g, unknown or other
  misc_feature (198)..(198): n is a, c, g, or t
  modified_base (322)..(322): a, c, t, g, unknown or other
  misc_feature (322)..(322): n is a, c, g, or t
  modified_base (363)..(363): a, c, t, g, unknown or other
  misc_feature (363)..(363): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccacctctcctgcagggccagtcagagtgttgacagcaacttggcctaggtaccagcagcaactggccaggcctcccaggcctcctcatctatgatgcactccacgcggcccacggtacncccagcctaggttcagtcggctaggtggggtctaggggacnggtacgttacacgttctaccactatccagtcacgcctggactcgtgtacggtagtactttggacttagtttacttacgttgtactacgtactaacttaaactaaacgttaacgtcgggtacctcggtaccttacgtacggtttccggggacggtaacggggtaccgtaaagggtacggaacggtactaaccgtaaaacgaaccgtggtaacgtcgtacggacctacgtaacgtactttccg

SEQ ID NO: 321448 - DNA, 627 bp, Homo sapiens
  misc_feature: GZ8MTXP02FQ9NG.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggcctcccaggcctcctcatctatgatgcactcccaaccgagggcccaccggtactacccaccgaccgacggttacgtacgtacgggtcgacggtaggggttcggtacggggtacgtacgtaagttccgtaacctcctaccaacccacgtacgacgacgacgccgtcgcgtacgtacgtgtaggttaagttttcgttactagttttaatttacgttacgttcgagtactattaaactaaataacttacggtcgtcgtcttcgtacgtttacgggacggggaggaccggtaaacggtgggaacgtacgtaacgaaaacggtaaacgtggtcggacgtacacgtaaccactcttcg

SEQ ID NO: 321449 - DNA, 602 bp, Homo sapiens
  misc_feature: GZ8MTXP02F3492.3.12.B01.1.454.CMB.2.raw
  modified_base (159)..(159): a, c, t, g, unknown or other
  misc_feature (159)..(159): n is a, c, g, or t
  modified_base (198)..(198): a, c, t, g, unknown or other
  misc_feature (198)..(198): n is a, c, g, or t
  modified_base (295)..(295): a, c, t, g, unknown or other
  misc_feature (295)..(295): n is a, c, g, or t
  modified_base (375)..(375): a, c, t, g, unknown or other
  misc_feature (375)..(375): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttnacgcagtttccagccaccctgtctgtgtctccagggganagagccaccctctcctgcagggccagtcagagtgtgacagcaacttggcctggtaccagcagcaacctggccaggctccacgctctcatctatgatnacactaccacgacggaccgaccgtacctaccgacgacgtacgtacgtacgtacgacgtacggtcggtcggtacggtacgngtacgtactacctacctacacactacacgacgacgtacgtacgacgtacgtacgtagtagttagttacgtacgttagtttagttacgtacgtacgtagtactactaactaacgtacgtacgtacgtacgtacgtacgtacgtacggtacggtacggacggtacggtacggtacgtacgtaacgtaacgtacgtaacgtacgtacgtacgtacgacgtacgtacgtcg

SEQ ID NO: 321450 - DNA, 567 bp, Homo sapiens
  misc_feature: GZ8MTXP02IVU6F.3.12.B01.1.454.CMB.2.raw
  modified_base (304)..(304): a, c, t, g, unknown or other
  misc_feature (304)..(304): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagaggacgccaccctctcctgcagggccagtcagagtgtgacagcaagttggcctggtaccagcagcaactggccaggcctccgagcctctcatctatgatgctacnccgacgacgggcccacggtactcccgagccaggttcagtgcgagtggngtggangtagttcactcncacatcagcagtccngactagtcgtagtagttatttacgagttaatttacgtacgttgtactagtactaaattaacaaacgttacggtcggtcctacggtccttacgtacggttacgggacgggtaacggtaccggtaaggtagtaacgtaacgtaaacgaaacgtacgtggtacgacgtacacctactagtcgtcg

SEQ ID NO: 321451 - DNA, 613 bp, Homo sapiens
  misc_feature: GZ8MTXP02HUPZD.3.12.B01.1.454.CMB.2.raw
  modified_base (198)..(198): a, c, t, g, unknown or other
  misc_feature (198)..(198): n is a, c, g, or t
  modified_base (328)..(328): a, c, t, g, unknown or other
  misc_feature (328)..(328): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccgagggganagacgccacctctcctgcagggccagtcagagtgttgacagcaacttggcctggtaccagcagcaacctggaccaggcctcccaggcctcctcatctatgatgcactccaaccgagggcccaccggtacncccagcctaggtcaggtcgacgaggttcgggtctggggacagtacgttcacttccgtccaaccatcacgtcacgtcctgcacgtctagtaggtagtttgacttagtttattacgtagttctagtactaattaactaacttaacgtcggtaccgtcggtccttacgtacggtttacgggacgggtaacggggtaaccggtaaagggttacgggaaacgtacgtaaaccgtaaaaccgtacgtaacggttacggaccgttacggacctaccgtaacgttacgtttcg

SEQ ID NO: 321452 - DNA, 724 bp, Homo sapiens
  misc_feature: GZ8MTXP02JYOSV.3.12.B01.1.454.CMB.2.raw
  modified_base (341)..(341): a, c, t, g, unknown or other
  misc_feature (341)..(341): n is a, c, g, or t
tcagagacgcactccacgaccggtgctcgatttagtagtgtagattccgcgggggaggaactgctcagttaggacccagacggaaccatggaagccccagcgcatcttctcttcctcctgctactctggctcccagatgccactggagaaatggggttgacgcagtttccagccaccctgtctgtgtctccgaggggagagacgcccaccctctcctgcacgggccagtcaggagtgttgacagactaacgttggcctggtaccagcagcaaccgtggccaggcctcccgaggtcctcctcacttctatgatcgctactccaccgacggcccaccggtacncccgagccgaggttcaggtcggcgtagggtcgggtcgtaggggactaggtacgttccgacctcctaccgaaccctactaccgacgccgtaacgtcccgtaggacccgtaaggttcgtagggtaacgggtttacttttacggtaccgtttaaaggtttttacgttaaccggttcgggttacctaacgttaccttaaacgtttaaaaccttaaacgttaaacccgggttccgggtaaccccgtttcgggttccctttaccggttacccgggtttacgggggaaccggggtaaaccggggaccggtaaagggttacgggaactaaacgaaaccgtaaaacggtacgttggaccggtcgtacgacctaccgtagttccgtttaaccg

SEQ ID NO: 321453 - DNA, 564 bp, Homo sapiens
  misc_feature: GZ8MTXP02JW1AL.3.12.B01.1.454.CMB.2.raw
  modified_base (378)..(378): a, c, t, g, unknown or other
  misc_feature (378)..(378): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccatccaccctgtctgtgtctccgaggggagagacgcccaccctctcctgcagggccagtcagagtgttgacagcaacgttggcctggtaccagcagcaacctggccaggcctcccgaggcctcctcatctatgatgcactcccacgacgggcccaccggtctccccgagcccgtaggttcacggtcggctagggtcgggtctggggacnggtacgttcacttccgacaccgtatccagcacgcctgctagtcgtagaggttatttgcttagtttacttacgtgtctagactaattactaacgtaacgtcgtcctcggtcctcgtacgttcggacggtacggaccgaagggtgacgacgtacaaacggtacgtcggtggcgtcgacactcgtctcg

SEQ ID NO: 321454 - DNA, 641 bp, Homo sapiens
  misc_feature: GZ8MTXP02F89NY.3.12.B01.1.454.CMB.2.raw
  modified_base (198)..(198): a, c, t, g, unknown or other
  misc_feature (198)..(198): n is a, c, g, or t
  modified_base (361)..(361): a, c, t, g, unknown or other
  misc_feature (361)..(361): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccaccctctcctgcagggccagtcagagtgttgacagcaacttggtctggtaccagcagcaactggccaggctcccagcctctcatctatgatgcatccacgagggcccaccggtactcccgagccgtaggttcagtcggctaggtcggtcgtgggacnggtattcactctccacatcagcacgctgctagtctggtaggttagttttgacgttaaggttttaacttacgttggttctaagtactaaactttaaactaaacgttaaaccgtcggtacccgttacggtccttaccgttaccggttttacggggaccgggttaaacggggaaacccggtaaaggggttaacggaaacggttaaaccgtaaaccggtaaaaaccggtaacggttaacggttacgggaccgttaccggaccgtaacctacgttccgttttacg

SEQ ID NO: 321455 - DNA, 529 bp, Homo sapiens
  misc_feature: GZ8MTXP02HS0NA.3.12.B01.1.454.CMB.2.raw
  modified_base (319)..(319): a, c, t, g, unknown or other
  misc_feature (319)..(319): n is a, c, g, or t
  modified_base (354)..(354): a, c, t, g, unknown or other
  misc_feature (354)..(354): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagctaacttggcctggtaccagcagcaactggccaggctcccaggctcctcatctatgatgcatccacagggccaccggtancccagccaggttcagtggcagtgggtctggggacngtagttcactctcaccatccagcacggtcctcgcagtcgtgtaggtagttgtctagttattacttgtctagtactatactaataaactacgtcgtcggtctcgtacgttcggtcggacgggaccggaacggtaggagacgacgaacgaacgtaagtggcgtcgacacactcttcg

SEQ ID NO: 321456 - DNA, 574 bp, Homo sapiens
  misc_feature: GZ8MTXP02IULE8.3.12.B01.1.454.CMB.2.raw
  modified_base (373)..(373): a, c, t, g, unknown or other
  misc_feature (373)..(373): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagctaacttggcctggtaccagcagcaacctggccaggcctcccgaggcctcctcatctatgatgcactccaccgagggcccaccggtactccccgagcccaggttcaggtcggctaggtggggtctaggggacnggtgttcacttcctccaactatcagcagcctgccagttctggtaggttactttgacttagtttattactgtactagtactattaacaacttacgtcggtccgtcggcttcgtacgtttcgggacgggtacgggaaccgtagggtaggaacgacgtaacgaaacgtagtggtcggactacgacctaccgtactaccgtttcg

SEQ ID NO: 321457 - DNA, 809 bp, Homo sapiens
  misc_feature: GZ8MTXP02FNK7U.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcagggccagtcagagtgttgacagcaacttggcctggtaccagcagcaacctggccaggcctcccaggccttccctcagtctatgttgcactcccaccgacgggcccacccgggtactccccgaagtccccgaaggtttccaggttcggacgtacggggttcggggtaccggttacggggaaccgtaaggttacgtttacctaacccttccggttaccccaaccccgtaattcccgaacgtacccgaacggtcccccgttaggcccgtaaggttccgttaacggggtaacggggtttacttttttagggtacctttaaagggtttttaaacctttaccggttcgtttaaccgaacgttaacccgttaaaattttaaacccgtaaaagtttaaacccgttacggggttaccccgttacccggggttccctttaccggttaccgggttttacccgggggtaaccgggggtaaaccgggggaaacccggtaaaggggttacgggaaacggtaaacgttaaccgaaaaccggtaaaccggttgggtaaccgggccttaccggaccctaccttaacggttacttaccggttttaccc

SEQ ID NO: 321458 - DNA, 581 bp, Homo sapiens
  misc_feature: GZ8MTXP02HL81V.3.12.B01.1.454.CMB.2.raw
  modified_base (199)..(199): a, c, t, g, unknown or other
  misc_feature (199)..(199): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (394)..(394): a, c, t, g, unknown or other
  misc_feature (394)..(394): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagacgccacctctcctgcagggccagtcagagtgttgacagcaacttggcctggtaccagcagcaacngcaggctccagctctnatctatgatgcatccacgacggccaccggtactcccagcctaggttcagtgcaggtggtgngggtacngtacgtcactctacaccatcagcacgctgcagtctaggagttntttgactagttttatacgttgtactatactaattaaactaaacgtaaaccgtggtacccgttacggaccttacgtaaaccgggtttccggggaacggggaaaacggggtaaccgtaaaacggggtggtaaacgaacgtaacgaaaacggtaccgtaaggtacggctacggaccaccgaattcggttc

SEQ ID NO: 321459 - DNA, 530 bp, Homo sapiens
  misc_feature: GZ8MTXP02GDF6N.3.12.B01.1.454.CMB.2.raw
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (396)..(396): a, c, t, g, unknown or other
  misc_feature (396)..(396): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgtgacagcaattggcctggaccagcagcaacngcagctccagctctnatctangatgcatcccacgagggacccaccggtatccccagccaaggttcaggtgcaggtcggggtctaggggacaggtattcaacttcaccgaccagtccagcacgcctgcagtcngtaggtatttgactagtttattactagtcagtactaattacaaataacgtgtcgtcgttactacgttcgggaggtacgggacgtagggtagagactacgaaaacgacgtgtgactacgacactactctagttac

SEQ ID NO: 321460 - DNA, 657 bp, Homo sapiens
  misc_feature: GZ8MTXP02FOB91.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacgttggcctggtaccagcagcaaccgtggccaggcctcccaggcctcctcatctatgatgcactccacgacggcccaccggtactcccagccgtaggttcaggtcggctaggtcggggtcgtagggactaggtcttaccaccgttcctaccaacctatccgaacgccacgcccgtagctagtcgaggtacggttattttgacgttagttttacttacgttgtactagtactaaagttaacctaaacgttaacgtcggaccgttacggtaccgtacgtttaccgggtttaccggggacggggtaaaccgggtaccggtaaagggggtacggtaacggtaacgtaaaaccggaaaacggtaacggttaacgggtacgggtacctaccggtcctaaaacctcgtttcccggtttacg

SEQ ID NO: 321461 - DNA, 793 bp, Homo sapiens
  misc_feature: GZ8MTXP02F0ZWI.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggctcccaggcctcctcatctatgatcgcactcccaccgacgggacccaccggtactccccgagccgtaaggttccaaggtcggaccgagggtcggggttcgtacggggaactggtacgttccgtaaccgttcctaccaaccctaacgttaccgaaacggcccgtaaaccggtcccgttacggacccgttaaacggggttccgttaacggggttacgggtttaagttttttcgggaaccttttaaagggttttttaaactttacccggttaggtttaaccctaaggtttaacctaaaacgttttaaaaccgtaaaacctttaaaacccgggttccggggttacccccgtttaaccggggtcccgtttaaccggttaacccggggtttacccgggggaccgggggtaaacgggggtaaacccggtaaagggggttacggtaaacggtaaacgtaaaccgtaaaaccggtaacgttaacggggtacggtacgttacggaccgtacctaacgttacgtttccg

SEQ ID NO: 321462 - DNA, 614 bp, Homo sapiens
  misc_feature: GZ8MTXP02F8TVX.3.12.B01.1.454.CMB.2.raw
  modified_base (199)..(199): a, c, t, g, unknown or other
  misc_feature (199)..(199): n is a, c, g, or t
  modified_base (327)..(327): a, c, t, g, unknown or other
  misc_feature (327)..(327): n is a, c, g, or t
  modified_base (366)..(366): a, c, t, g, unknown or other
  misc_feature (366)..(366): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagcccaccctctcctgcagggccagtcagagtgttgacagcaacgttggcctggtaccagcagacaaccgtggccacggcctcccaggtcctcctcatctatgatgcatccacgcggccacgtacncccagccaggttcaggtcggacaggtcgggctggggacngtacgttcacgttcaccacatccagcagcctgacagtcaggtaggttattttcgagttagttttattacgttggttacacgtactaacgttaaactaaacgtaaccgtcgggtccctacggtcctaccgttaccgtttacgggggaccggaacggggaccgttaacggggtaggaaacgtacgtaaaccgaaaacggtaaccgttaaggtcgggtacttacggccgtaaccgttactcggtttaaccg

SEQ ID NO: 321463 - DNA, 691 bp, Homo sapiens
  misc_feature: GZ8MTXP02GFHY1.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgtgacagcaactggcctggtaccagcagcaaccgtggaccagggcctcccgaggcctccgtcatctatgatgcatccacgacgggcccaccggtatccccagccaggttcaggtcggctaggtcggggtcgtgggactgggtaacttcgaaccttcgtaccacctatacgacgaccaggccccttagacccgtagtctagggtaagggtttacttttcggacgttaaggtttttaacttaccgtgggttacgtaagtacttaacgttaaactaaaacgtttaaaccgtcgggtcccgttaccgggacctttacccggtaaccgggttttccggggaaccgggggtaaacgggggttaacccgaaaggggttacggggaaaggtaaccgtaaacccggtaaaacggtaacccgttggggttacggaccttacgggtaaccaacctacggtttactttccg

SEQ ID NO: 321464 - DNA, 592 bp, Homo sapiens
  misc_feature: GZ8MTXP02H65JS.3.12.B01.1.454.CMB.2.raw
  modified_base (337)..(337): a, c, t, g, unknown or other
  misc_feature (337)..(337): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgcccaccctctcctgcagggccagtcagtagtgttgacagcaacgttggcctggtaccagcagcaacctggccaggcctcccgaggcctcctcattctatgatgcactccaccgagggccccaaccggttaccncccgacgtccgtaggttcgaggtcggcgtagggtcgggtcgtagggactaggtacgttccacctcctaccacctatcgacgacacgccgtcgacgtagtcgtaggtaggttatttacgtacgttagtttacttacgtcgtacgtagtactaattaacaacgtacgtcgtccgtcgtctcgtacgttcggacggtacggacgaggtacgacgtacgtaacgaacgtacgtgcgacgtacgacctactcgtacgtcg

SEQ ID NO: 321465 - DNA, 524 bp, Homo sapiens
  misc_feature: GZ8MTXP02FFTRR.3.12.B01.1.454.CMB.2.raw
  modified_base (198)..(198): a, c, t, g, unknown or other
  misc_feature (198)..(198): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccagggganagagccacctctcctgcagggccagtcagagtgttgacagcaacttggcctggtaccagcagcaacctggccaggctcccaggctcctcatctatgatgcatccacgagggcccaccggtatccccagccaggttcagtcggcagtgggtctggggacnggnttcacttcncacatcagcagcctgcagtcngagtatttgactagtttatactgtacagctaattaacaataacctggcctcggctcacgtttcggcggacgggtaccgaagggtggaagaactacgaaaacgtaacctggtaaggctcggaccacactcttacg

SEQ ID NO: 321466 - DNA, 635 bp, Homo sapiens
  misc_feature: GZ8MTXP02IOYR4.3.12.B01.1.454.CMB.2.raw
  modified_base (295)..(295): a, c, t, g, unknown or other
  misc_feature (295)..(295): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaactggccaggctcccgaggcctcctcatctangatgcactccaccgacggcccacggtactccccgagccgtaggttcaggtcggctaggtcggggtctaggggacagggtacgttccacgttcctaccaccgtattccgacgccacgtccctggcgtagttcgtggtaggttattttagacgttagtttatttacgttagtactagtacttaacgttaactaaacgttaccgtacggtcccgtcggtccgttaccgtacgtttccggggacgggtacgggtaaccgtaaaggggtacggaacgtaaccgtaaacgaaacgtaacgttaacggtacggtaccgttacggacctaaccgtacgttacgttccg

SEQ ID NO: 321467 - DNA, 711 bp, Homo sapiens
  misc_feature: GZ8MTXP02IOEUP.3.12.B01.1.454.CMB.2.raw
  modified_base (216)..(216): a, c, t, g, unknown or other
  misc_feature (216)..(216): n is a, c, g, or t
tcagagacgcactccacgaccggtgctcgatttagtagtgtagattccgcgggggaggaattgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctccngcgagggccagtcagagtgttgacagcaacgttggcctggtaccagcagcaaccgtggccaggcctccccgaggtccctccgtcactctaatgatgacctactccccaaccgacggggacccctaacccgggttacctcccccgaacggtcccgtaagggtttcccgaagggtcgggccgtaggggttggggtccggttaggggacagggttacgtttaccaccttcctaccaacctactccaacgccacgtccgcgcgtacgttctaggttacggtttagtttttcggactttagttttaatttaccgttaggttactaaggtacttaagttaaattaaacgttaagttggggttacgggtaccgggtttaccgggaacgggtaaaacggggaaccggtaaaagggtaaaacgtaaaaggtaaacctaaaacggtaaccgtagggtacggctacggaacctactacttcttagttacctttcacgtttaccccg

SEQ ID NO: 321468 - DNA, 435 bp, Homo sapiens
  misc_feature: GZ8MTXP02F8JWA.3.12.B01.1.454.CMB.2.raw
  modified_base (235)..(235): a, c, t, g, unknown or other
  misc_feature (235)..(235): n is a, c, g, or t
  modified_base (427)..(435): a, c, t, g, unknown or other
  misc_feature (427)..(435): n is a, c, g, or t
tcagagacgcactccacgaccggtgctcgatttagtagtgtagattccgcgggttgtagtcggtgctcccaccatagtgggagcaccgactacaacccgtccctcaagagtcgagtcaccatatcagtagacacgtccaagaatcagatctccctgaacgtgacctctgtgacggccgcagacacggccgtctattactgtgccagttcgtcacatatgcttacgtctggggganatatcgttttctctgacaacgtggggccagggttccctggtcaccgtctcctcagcctccaccacggcccatcgtctccccctggccaccctcctccaagagccacctcgtggggcacgagcccggccctggggctcgcctggcaggactacgttccgagtgcgtctctgagcggctggcaaggcgcagagnnnnnnnnn

SEQ ID NO: 321469 - DNA, 654 bp, Homo sapiens
  misc_feature: GZ8MTXP02FQF7N.3.12.B01.1.454.CMB.2.raw
  modified_base (200)..(200): a, c, t, g, unknown or other
  misc_feature (200)..(200): n is a, c, g, or t
tcagagacgcactccacgaccggtgctcgatttagtagtgtagatcccgcgggggaggaactgctcagttaggacccagacggaaccatggaagccccagcgcagcttctcttcctcctgctactctggctcccagatgccactggagaaatggggttgacgcagtttccagcccaccctgtctgtgtctccgagggganagagcccaccctctcctgcagggccagtcagtagtgttgacagctaacgttggcctggtaccagcagcaacctggccaggcctcccgaggtcctcctcatctatgatgcactccgaccgacggcccaccggtactccccagcctaggtcaggtgcgtaggtggtcgtgggaactggtacgtcaccgtctaccacctatcacgctacgcctgctagtacgtgtaggttagtttcggatttaagtttacttacgtcgtacgtaagtactaaattaacctaaaacgttaaccgtcggtacccgttaccgggtaccttaccgtaccgggttttaccggggaacggggtaaaccgggggtaacccggtaaacggggtagggtaacggtaacgtaaaccgtaaacggtaacgtaacgggtcggttaccgtaccggaccgtaccctacgtttctttacccg

SEQ ID NO: 321470 - DNA, 665 bp, Homo sapiens
  misc_feature: GZ8MTXP02HS44E.3.12.B01.1.454.CMB.2.raw
  modified_base (355)..(355): a, c, t, g, unknown or other
  misc_feature (355)..(355): n is a, c, g, or t
tcagagacgcactccacgaccggtgctcgatttagtagtgtagattccggcgggggaggaactgctcagttaggacccagacggaaccatggaagccccagcgcagcttctcttcctcctgctactctggctccagatgccactggagaaatggggttgacgctagtttccagccacctgtctgtgtctccgaggggagagacgccacctctcctgcgagggccagtcagtagtgttgacagcaacgttggcctggtaccagcagcaaccgtggaccaggcctcccgaggtcctcctcaacttctagtggtatcgaccactcccgaaccgacggggccctaaccgggttaacccncccgacgtaccgtaggttacgacggtcggacgtagggtacgggtacgtagggacgtgtacgttcaccgttccaccaactactaccgacgtaccgaccgtctacgacgtacgttcgtaggttacgtttacgtttacgtacgtttaacgtttattacgttacgtacgtactactaagttaactaaacgttacgacggtacgttccggtacttacgtacgggttacgggaacgggtacggtaacggtaaggtacgaaacgtacgtaacgaaacggtacgtggtacgacgtacgaccgtacttacgttacgtcg

SEQ ID NO: 321471 - DNA, 587 bp, Homo sapiens
  misc_feature: GZ8MTXP02FMFPI.3.12.B01.1.454.CMB.2.raw
  modified_base (199)..(199): a, c, t, g, unknown or other
  misc_feature (199)..(199): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagcccaccctctcctgcagggccagtcagagtgttgacagcaacttggcctggtaccagcagcaaccgtggccaggcctcccaggcctcctcatctatgatgcactccaccgagggcccaccggtatccccagcctaggttcacgtgggcaggtcggggtctaggggacaggtcgttcactcgtaccaacactcagcacgcctgcgtacgtcgtgtaggttattttgacgttagtttattactgtactagtactaattaaacaacttaaccgtcggtccgtaccggtcctacgtacggtttcgggacgggtacgggacgaaacgggtggaaacgtacgtaacgaaacgtaacgtggtacgtcgtacgacctacgtactcgtttacg

SEQ ID NO: 321472 - DNA, 593 bp, Homo sapiens
  misc_feature: GZ8MTXP02JLEZ1.3.12.B01.1.454.CMB.2.raw
  modified_base (201)..(201): a, c, t, g, unknown or other
  misc_feature (201)..(201): n is a, c, g, or t
  modified_base (532)..(532): a, c, t, g, unknown or other
  misc_feature (532)..(532): n is a, c, g, or t
tcagagacgcactccacgaccggtgctcgatttagtagtgtagattccccgggggaggaactgctcagttaggacccagacggaaccatggaagccccagcgcagcttctcttcctcctgctactctggctcccagatgccactggagaaatggggttgacgcagtttccagccaccctgtctgtgtctccgaggggaaanagccaccctctcctgcagggccagtcagagtgttagcaactactagcctaggtaccaacagaaacctggaccaggctcccaggctcctcatctatgatgcatccaaacgacggccacgtggcactccccagccgaggttcaggtcggactacggtgggtcgtagggacagtaccgttcacgttcctacacctatcgacgcacgtacctagacgtcccgtagtaagtacttttagactaagtttacttacgtgtacacggcaacggtacgtacgacctaacgtcgccttactacgtacgttcgggacggtacggacgagggtacggacgtanaacgtaaacgacgtaggtcgtctcggaacctactacgttcgcgttcttaccgctttccccg

SEQ ID NO: 321473 - DNA, 636 bp, Homo sapiens
  misc_feature: GZ8MTXP02HXJ6G.3.12.B01.1.454.CMB.2.raw
  modified_base (199)..(199): a, c, t, g, unknown or other
  misc_feature (199)..(199): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagacgccaccctctcctgcaggccagtcagagttgttgacagctaacttggcctaggtaccagcagccaacgtcggccaggcctcccaggtcctccctcattctatgatgcactccacgacggcccacgtactccagccgaggttccaggtgcaggtgggtctaggggacaggtgttaccacctcctcaaccgtatcacgcacgctcgcaagttcgtaggtagttactttgtacttaagtttactttactacgtactagtactaagttaattaaacgtaacgtgggttacggtcggtttacgggaaccgaaacgggtaaaccgtaaagggtaaaacgtaaaacgtaacgtaaaaccggtaaacgttacgggtaccgacgttaacggaaccctacgttaacgttccgttacggtttaccttactttaccgtttccccg

SEQ ID NO: 321474 - DNA, 573 bp, Homo sapiens
  misc_feature: GZ8MTXP02F0D9F.3.12.B01.1.454.CMB.2.raw
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgtgacagcaattggcctggtaccagcagcaaccgtggccaggcctcccgaggcctcctcatctatgatgcactccacgacggcccacggtactcccgagccgaggttcaggtcgctaggtcggtcgtgggactgacgttcactcncaacntacagcncgctnacgngtcgtgtagtatttgactagtttatacttgtactagtactaacttaactaaacgtacgtacggtacccgtcggtaccttacgtcggtttacgggacgggtacgggtaaccgaggggtaggaacgtacgtaacgaaacgtaagtcggtcggacgtacgacctactacgtcgtttcg

SEQ ID NO: 321475 - DNA, 591 bp, Homo sapiens
  misc_feature: GZ8MTXP02FV8FG.3.12.B01.1.454.CMB.2.raw
  modified_base (364)..(364): a, c, t, g, unknown or other
  misc_feature (364)..(364): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggcctcccaggcctcctcatctatgatgcactccaccgacgggcccaccggtactccccagcctaggtcagtggcaggtgggtcgtgggacnggtacgttcactccaccacatacagcacgcctgcagtctggagttatttgacttagtttacttagtgtacagtactaattaactaagtaacgtcggtacccgttcggtccttacgtaccggtttccggggacgggtaacgggaaccggtaaaggggtacggtaacgtaacgtaaccgaaaacgtaacgtggtacggacgttacggacctacgtacgttcgtttaccg

SEQ ID NO: 321476 - DNA, 538 bp, Homo sapiens
  misc_feature: GZ8MTXP02GAY1H.3.12.B01.1.454.CMB.2.raw
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaactggccaggcctccaggcctcctcatcatgatgcatccacgaggcccacggtatcccagccaggtcagtgcagtggtctgggacngattcactcncacatcagcagctgcagtctgagtatttgactagtttattactgttacagctaatacaaatactcgcctcggctacgtacgtttcgggacggtagggaaccgtaaaggggtcggaaagtacgtaacgaaaacggtaacctgggtacggacgttacggacctaaccctagttcgttacgg

SEQ ID NO: 321477 - DNA, 546 bp, Homo sapiens
  misc_feature: GZ8MTXP02GTSTC.3.12.B01.1.454.CMB.2.raw
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (357)..(357): a, c, t, g, unknown or other
  misc_feature (357)..(357): n is a, c, g, or t
  modified_base (407)..(407): a, c, t, g, unknown or other
  misc_feature (407)..(407): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgtgacngcaattggcctggaccagcagcacngcagctccngctcncatctatgatgcactccacgacgggcccaccggtactccccgagccgaggttcacggtggcgaggtgggtcgtgggacgngtagttcactcctaccaccatccagcacgctgactagtcgtggtaggttntttcgtacttagtttattacgttgtactagtactattaacaacttaacgtcgtctacggtcttacgtacgttcgggacggaacgggacgagggtacgagacacgaaacgacgtggtcgacgtcgactactacttcgtcg

SEQ ID NO: 321478 - DNA, 649 bp, Homo sapiens
  misc_feature: GZ8MTXP02GC9RD.3.12.B01.1.454.CMB.2.raw
  modified_base (409)..(409): a, c, t, g, unknown or other
  misc_feature (409)..(409): n is a, c, g, or t
  modified_base (439)..(439): a, c, t, g, unknown or other
  misc_feature (439)..(439): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcagggccattcagagtgttgacagctaacttggcctggtaccagcagcaaccgtggaccaggcctcccaggcctcctcatctatgatgcactccaccgacggcccaccggtactcccgacgccgtaggttcgacggtcggcgtaggtcggggtcgtaggggactaggtacgttcacgttccgtaccaccctntaccgaagccgaccgtcctagctagttccngggtaggtttatttcggtcttaagttttacgttacttgtacgtagtactaaactttaacaaaacgtttacgccggttaccgttcggtactttacccgtacggttcggggacggtaacgggtaaccgaaaggggttcggaaacgtacgtaaaacgtaaaaccggtaagtcgtaacggtccgtacggaccctaacctcgtttaccgtttccg

SEQ ID NO: 321479 - DNA, 545 bp, Homo sapiens
  misc_feature: GZ8MTXP02FOP8U.3.12.B01.1.454.CMB.2.raw
  modified_base (322)..(322): a, c, t, g, unknown or other
  misc_feature (322)..(322): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcacttggcctggtaccagcagcaacctggccaggctcccgaggcctcctcatctatgatgcatccacgagggcccaccggtancccagccaggttcaggtgcaggtgggtcngggacngtagttcatcncacntcagcagcctgcagtctgtaggtattttgactagtttattacgtgtcagtcattaacaataactcggtcctcggcttaccgacgtttcgggacggtaacggggaccgaaagggtcggtaaagacgttaaacgaaaacgtaacgtggtaggtctcggacctaccatcgtttacg

SEQ ID NO: 321480 - DNA, 753 bp, Homo sapiens
  misc_feature: GZ8MTXP02GHHXI.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgcagttccagccaccctgtctgtgtctcgaggggagagacgcccaccctctcctgcgacgggccagtcagagtgtgacagctaacgttggccgtggtaccagcgacgccaaccgtcggaccacgggtccctccccgaggtcccctcctctaactctagtgatcgacctacgtaccccgaccggacgggacccctaacccggttacctcccccgaaggccgtagggttcacgggttcggccgtaggggtcgggtcgttacggggactacgggttcgttaccaccgttcctaccaacccgtatacccgacgggaccacccggtcctaggtcctaacggttcggtacgggttaagttttacgttttacggaacctttaaggtttttacttaacggttgttacgaagtacctttaaaacttaaccgtaaaacgtttacgggccggttaacccgttccggtacctttaccggttaacgggttcgggggaaaccggggtacggggtaaaccgtagggggttaacgacggtaaactaaccggaaaacgttagtcggtacggtaccgtacgtaccctaccgttacgttaccgtttaccg

SEQ ID NO: 321481 - DNA, 692 bp, Homo sapiens
  misc_feature: GZ8MTXP02HQMTT.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgctagtttccagccaccctgtctgtgtctccgaggggagagagcccaccctctcctgcgacggccagtcagagtgtgacagctaacgttggcctggtaccagcagccaaccgtggccacggcctcccgaggcctcctcattctatgactgccactcccgaccggaccggcccaaccggtactcccgagtccgtaggtcgacggtcggacgtgggtcgggtcgagggaactgggtacttaccgactccctaacgaccctatccgaagtccacgtccgtagcgtaacgttcgtagggttagtttcgtttacggtactttaacgttttattccgttagtacctaagtaccttagttaaactaacgtacggtccgtaccgttaccggtccttacgggtaccggttaccgggggaacgggtaaccggggtacgggtaaacgggtagggtaaacctaaccggtaaacccgtaaaggttacgggtaacggttcggacccgttaacggaaccctaaccggtttctttacgtttccccg

SEQ ID NO: 321482 - DNA, 653 bp, Homo sapiens
  misc_feature: GZ8MTXP02IWIEX.3.12.B01.1.454.CMB.2.raw
  modified_base (376)..(376): a, c, t, g, unknown or other
  misc_feature (376)..(376): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagctaacttggcctggtaccagcagcaaccgtggccaggcctcccgaggcctcctcatctatgatgcactccaccgacgggcccaccggtactccccgagcctaggttcaggtcggcgaggtcggggtctaggggacnggtacgttacaccgtcctaccaacctatccagcacgcctggactagtcgtaggtaggttatttgacgttagttttacgttacttgtacgtacgtacttaattaactaaacgttaaccgtcggtacccgtcgggtaccttaccgtaccggtttaccggggacggggtaacgggtaacccggtaaacggggtgggtaaacgtacgtaaaaccggaaaaccggttaacggtggtaaccgggtacgttaccggaccgtaaccctaacgttaccgtttaccg

SEQ ID NO: 321483 - DNA, 737 bp, Homo sapiens
  misc_feature: GZ8MTXP02JTHUS.3.12.B01.1.454.CMB.2.raw
  modified_base (246)..(246): a, c, t, g, unknown or other
  misc_feature (246)..(246): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctcgaggggagagacgcccaccctctccgtgcgacgggccagtcagtagttgttacganagactaacgttcggccgttaggtaccgaggtacacgacctaaccgtcggaccgacggtcctcccgacggcccttcccgtacactttactatggtaactcgacctacgtaccccgaacccggaccggggtacccctaaccgggtacctaccccgacgtcccgtaacggttcgaacggtcggtcgtaggttcggggtcgaggggactgggtacgttacaccgttccacctaacctagaccaacgtccaacggtccctacggacctacggttcgttaggggtaaggtttcgttttcggtaacttttacgtttaccgttaaagtttcgtaacggtatacccttaacttaaaacgtaaagtttacccggacggtcccgttcgtacccgttcccgttaacgggtttccgggaacggggtaaccggtaggaaacgggttggaacgtaactaacggaaacgtacgtggtacgccgtacgacctaccgtagttcgtaccg

SEQ ID NO: 321484 - DNA, 730 bp, Homo sapiens
  misc_feature: GZ8MTXP02FSSOK.3.12.B01.1.454.CMB.2.raw
  modified_base (309)..(309): a, c, t, g, unknown or other
  misc_feature (309)..(309): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgcagtttccagccacctgtctgtgtctccgaggggagagacgccaccctctcctgcacgggccagtcagagtgttgacagactacgttggcctaggtaccagcacgccaaccgtggaccaggccctcccaggtcctcctacatctangactcgactacgtacccaccggaccggaccccgtaacccggtaccgtccccgaacggtcccgtagggttacacgggttacggcgtacggggttcggggtcggttacggggaactacggggtacttaccgaccgttacctacccaactactaccgaacgccgtaacgtccgcgaccgtgttacgtaggttaaacggttgttttacgaccgtttaaggttttaacgttaccgttggtaaccgtactaaccgtttaaacttaaaacctaaaacgtttaccggttacggggtaccccttcggggtaaacccttcggttacccgggtttacggggaacggggtacggaaaccgtaaaggggtacggaacgtaaccgttaaaccgaaaagttacgtgggtacacggtacactacctagttcctacgg

SEQ ID NO: 321485 - DNA, 655 bp, Homo sapiens
  misc_feature: GZ8MTXP02IG7DK.3.12.B01.1.454.CMB.2.raw
  modified_base (163)..(163): a, c, t, g, unknown or other
  misc_feature (163)..(163): n is a, c, g, or t
  modified_base (198)..(198): a, c, t, g, unknown or other
  misc_feature (198)..(198): n is a, c, g, or t
  modified_base (313)..(313): a, c, t, g, unknown or other
  misc_feature (313)..(313): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgnagtttccagccaccctgtctgtgtctccagggganagagccaccctctcctgcagggccagtcagagtgttgacagcaacgttggcctggtaccagcagcaaccgtggccaggctacccgaggcctcctcatctatgatgcatccaacgnggcccacggtactcccgagcctaggttcaggtcggactaggtcggggtactggggaactagggtacgtttcaccttccgtaccacatccgacgacgacgcctacgctaacgttcgtacggtaaggttatttcgacttaagttttactttacgttgttacgtagtaccttaaacgttaaactaaagttaaacccgtcggtaccccgttcgggtacccttaccgtaccgtttaccggggaccggggtaaacggggtaacccggtaaaggggttacgggaaacgtacgtaaaccgaaaacggtaaccgtaaggtacggactacggacctacccgtatacgtttcg

SEQ ID NO: 321486 - DNA, 635 bp, Homo sapiens
  misc_feature: GZ8MTXP02HR4KB.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgcccaccctctcctgcgacgggccagtcagagttgttgacagctaacgttggcctggtaccagcagcaacctggccaggcctcccgaggcctcctcattcgtatgatcgacactacccgaccgacgggcccgtaaccggtactaccccgagtcccgtaggttcgacggtcggccgtagggtcggggtcgtacgggactgggtacgtttacacttccctaccaacctacgtacacgccacgttcccagcctaacgtgtaggtagttctttgactttagtttacttgtcgtactaagtcttaacgttacaaacgttacgtccggtcctcggtacttccgttacgggttcgggacgggtaaacgggtaccgagggtacgaagttaccgaaacggtaaacgtcgttggcgacgtcgacttacccgttcttacgtcg

SEQ ID NO: 321487 - DNA, 588 bp, Homo sapiens
  misc_feature: GZ8MTXP02G9FJQ.3.12.B01.1.454.CMB.2.raw
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcaggccagtcagagtgttgacagcaacttggcctggtaccagcagcaacctggccaggcctcccgaggcctcctcatctatgatgcactccacgacgggacccaccggtactccccgagccgtaggttcacggtggcgtaggtcgggtcgtgggacaggtacgtttcacttccacgacctatcacgtcacgcctgactagtctggtaaggttactttgacttagttttaattaccgttagtactagtactaatttaaacaaacgtacgtcggtacctcggccttacgtacgttcggacggagggtaccaaggggtgaacgtacgtaacgaaacggtacgtggacggtcctaggacctacgtacgttcttacg

SEQ ID NO: 321488 - DNA, 641 bp, Homo sapiens
  misc_feature: GZ8MTXP02GT1SY.3.12.B01.1.454.CMB.2.raw
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgcccaccctctcctgcagggccagtcagagtgttgacagcaacgttggcctggtaccagcagcaaccgtggccaggcctccagcctccnatctangatgcactccaccgacggcccctaaccggtactccccgagccgtaggttcacggtcggactagggtcgggtcgtaggggaactgggtaacgttcaccgttctacccgactactccgagccacgtcctgacctagtctaggtagttatttcgacttagttttacgtacgttgtactagtacttaaattaaccgtaaacttacggtcggtcgttaccggtctttaccgtacgggtttacggggaaccgggtaacggggtaaaccgtaaggggttacggaaacgtaacgtaaccggaaaacgtcgtaaggttacgcttacggacttaaccgtacgttcgtttaacg

SEQ ID NO: 321489 - DNA, 590 bp, Homo sapiens
  misc_feature: GZ8MTXP02HSXS4.3.12.B01.1.454.CMB.2.raw
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (286)..(287): a, c, t, g, unknown or other
  misc_feature (286)..(287): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
  modified_base (363)..(363): a, c, t, g, unknown or other
  misc_feature (363)..(363): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccgaggggagagagccaccctctcctgcagggccagtcagagttgtgacagcaattggctggtaccngcagcacngcagctccngctccnatctangnngnacnccacgacggccacggtcnccagccaggtcagngcaggtggtctcggggangggtactcactctacacctancagcacgctcgcgtacgttcgagttagttagtttcgtacgtttaacgttttaagttcgttacgtacgtaactacttaaattaactaaacgtaccgtacggtaccgttacggtacgttacgttaccggttacgggacgggtaacgggtaacgtaaaggggtacggtaaacgtaacgaaacgtaacggtacgttcggtacggacgtacgacctacgttacgttcgtacg

SEQ ID NO: 321490 - DNA, 564 bp, Homo sapiens
  misc_feature: GZ8MTXP02IINKD.3.12.B01.1.454.CMB.2.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (299)..(299): a, c, t, g, unknown or other
  misc_feature (299)..(299): n is a, c, g, or t
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
  modified_base (455)..(455): a, c, t, g, unknown or other
  misc_feature (455)..(455): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccacctgtctgtgtctccagggganagagccacctctcctgcagggccagtcagagtgttgacagtactagtcgtcgtacacncganacaacctacgcgacgcgtccacgcgtcctcatactactgntagcgatccacgacggccgacccgtactccacgacacgtcgagtggcgtagtggtcgtggacgagtggttcactccgttccacctacncgtaccncgacgccgtgacgtagtcgtaggtagttagttttacgtcgttagtttactttacgtcgtanacgtactattaacaaatacgtcgtccgtcgtctactacggttcggacggaacggacgaggtggaacacgtaacgaaaacgtcgagtgacacgacaccgtctcgtacgtc

SEQ ID NO: 321491 - DNA, 708 bp, Homo sapiens
  misc_feature: GZ8MTXP02I1NH6.3.12.B01.1.454.CMB.2.raw
  modified_base (260)..(260): a, c, t, g, unknown or other
  misc_feature (260)..(260): n is a, c, g, or t
  modified_base (299)..(299): a, c, t, g, unknown or other
  misc_feature (299)..(299): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgctagtttccagccaccctgtctgtgtctccgaggggagagacgccaccctctcctgcaggccagtcagagtgtgacagctaacgtggcctggtaaccngcagcaacgtggccaggctcccgaggcctcctcatctangtatcgaccatccccgaccgtacgggacccctaaccggtactacccccgaggtacccgtaaggtttccaaggggttcggacgagggttcgggggtacctagggggaacacgggttacgttaccctaaccgttactacccaaacccgtaaattcccgaaacgccgaaacgtcccgttgacccgttaagttcgttaggtaggtttattttcggagttacgtttttaacttacgttactacgtacgtactaaattaaacgtaactaacgttcggacccgttaggtccctacgttaccggttacggggtacggaaaacggggtaccgtaaaggggttacgaacgtaacgttaaaacgaacggtaaacgttaacgggacgtacgtacggaaccctactaccggttctttaaccg

SEQ ID NO: 321492 - DNA, 574 bp, Homo sapiens
  misc_feature: GZ8MTXP02H8MGI.3.12.B01.1.454.CMB.2.raw
  modified_base (198)..(198): a, c, t, g, unknown or other
  misc_feature (198)..(198): n is a, c, g, or t
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggangagccaccctctcctgcagggccagtcagagtgttgacagcaacttggcctggtaccagcagcaacctggccaggcctccaggcctctcatctatgatgcatccacgnggcccacggtacnccgagcgtagtcncgngcgaggtcggtcngggactgtacgttcacgtccacacgatcacgcgacgtctgcgtacgtcgtagtagttgtttacgtacgttagtttacgttacgttcgtactagtacttaacgtaactaacgttacgtcgtccgtcgtctaccgttacggttcggacggtacgggacgtaacgggtacgacgtaacgtaacgtaaacgtacgtggtacgacgtacgtacctaccgtacgttacgtcg

SEQ ID NO: 321493 - DNA, 631 bp, Homo sapiens
  misc_feature: GZ8MTXP02HQ6Q0.3.12.B01.1.454.CMB.2.raw
  modified_base (299)..(299): a, c, t, g, unknown or other
  misc_feature (299)..(299): n is a, c, g, or t
  modified_base (336)..(336): a, c, t, g, unknown or other
  misc_feature (336)..(336): n is a, c, g, or t
  modified_base (381)..(381): a, c, t, g, unknown or other
  misc_feature (381)..(381): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgcagtttccagccaccctgtctgtgtctccgaggggagagacgcccaccctctcctgcagggccagtcagagttgttgacagctaacgttggcctggtaccagcagcaaccgtggccaggcctcccgaggcctcctnatctatgatgcactccaccgacgggcccaccggtacnccccagccgtaggttcacggtggacgtggtcggggtctggggacnggtacgttcactccgtacaccatcgacgtcacgtcctagctacgtcgtaggtaggttacttttgacgttagtttattacttcgtactagtctaacttaacgtaaacgttaaccgtcggtcccgttcggtccttaccgttaccggtttccgggacgggtaaaccggggaccggtaaacggggtggtaaacgtacgtaaccgaaaacggtacgttaacggcggtcgtcggacctacctacgtttccgttacg

SEQ ID NO: 321494 - DNA, 721 bp, Homo sapiens
  misc_feature: GZ8MTXP02G8B19.3.12.B01.1.454.CMB.2.raw
  modified_base (312)..(312): a, c, t, g, unknown or other
  misc_feature (312)..(312): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaagtggggttgacgctagtttccagccaccctgtctgtgtctccgaggggagagacgccaccctctcctgcgagggccagtcagagtgtgacagactaacgttggcctggtacccagcacgaccaaccgtcggaccacggccctcccgacggtcctacccctntacttcgtataggtactcgcctacctacccgaaccggacgggacccctaaccgggtacctcccgacgtaccgtaggttaccgaggtcgacgtacgggtcggggttacgtacggggaactaggtacggttacctaccgttacctaccctaaccgactaccgacgaccgtaaccgtcctacggactaacggttcgtaggtaaggtttagtttacggtacgtttaagtttacttacgttgtaccgtatactaactttaaacgaaaccttagtaccgtaccgtacgtacttacgtacggttacggggaacggtacgggtaaccggtaaagggtacggtaaacgtaacgtaaaccggtaaaacgtaccggtaaggtacggtaccggtaacactaccgtaactttcggtttaccg

SEQ ID NO: 321495 - DNA, 653 bp, Homo sapiens
  misc_feature: GZ8MTXP02FGO9G.3.12.B01.1.454.CMB.2.raw
  modified_base (199)..(199): a, c, t, g, unknown or other
  misc_feature (199)..(199): n is a, c, g, or t
tcagagacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgttgacagctaacttggcctggtacagcagcaacctggccaggcctcccgagcctcctcatcctatgatgcatcccacgaggcccaccggtatccccagcctaggttcaggtcggacaggtcgggtctggggacaggtcgttaccacttcctaccaaccctatacccgaacgcccgtaacgccccgttagaccgtaacgttccgtaggtaacgggttatttttcggactttaaggttttaacttacgtcggttactagtacttaaactttaaactaaacgttaaacgttccggggtacccttccggtaccttaccgtttaacgtttcgggggaccgggtaacggggtaaccggtaaacggggtaggacgtaacgtaaccgaaaacggtaacgtgtacggctcggacctaacctgtcttacg

SEQ ID NO: 321496 - DNA, 543 bp, Homo sapiens
  misc_feature: GZ8MTXP01B4DZD.4.25.C03.1.454.CMB.2.raw
  modified_base (214)..(214): a, c, t, g, unknown or other
  misc_feature (214)..(214): n is a, c, g, or t
  modified_base (363)..(363): a, c, t, g, unknown or other
  misc_feature (363)..(363): n is a, c, g, or t
  modified_base (501)..(501): a, c, t, g, unknown or other
  misc_feature (501)..(501): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattaaccttcaggagctatgggatgcactgggtccnccaggctccaggcaagggggctgggagtgggtggcacttatttgggtatgatggaagtaagaaatactatgcagagtccgtgaagggccgattcaccatctccagagacaattccaacacacgctgtttctgcaaatgaacagccctgngagccgaggacacggctgtgtatcactgtgtcagagatgccgagggccgttaccctctcggtccgttcgactagttagtggtatggacgtcgtggggtcctagggactcgggtcaccgttctccttcgacgccttccnccgacgggcccagtccgtccttccccttggccaacccgtccc

SEQ ID NO: 321497 - DNA, 528 bp, Homo sapiens
  misc_feature: GZ8MTXP01AGR83.4.25.C03.1.454.CMB.2.raw
  modified_base (303)..(303): a, c, t, g, unknown or other
  misc_feature (303)..(303): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtcgtgggggagcgttgtccagcctgggaggtccctgagactctcctgtgcagcgtctgcattcaccttcaggagctatgggatgcactggggtccncaggctccaggcaagggggctgggagtgggtgctacgttattgggatgatggaaaagtaagaatactatgcagagtccgtagaagggccgattcacatctaccagagacaattccaaacaacacgcttgttctgacaaatgaacagcctgacgagccgaggaacacggctgttgtatcacgttgttcgtcagaagactggaccggtaacgggccgtttaaccccg

SEQ ID NO: 321498 - DNA, 580 bp, Homo sapiens
  misc_feature: GZ8MTXP01CI14B.4.25.C03.1.454.CMB.2.raw
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcacatggagtttgggctgagcttgggttttcctcgttgcttcttttaagaggtgtccagtgtcacgtgcgcctggtggagtcgtgggggagcgttgtccagccgtggggacgtccctgagactctctgtgcagcgtctgcattcacttcagganctagtggatgcacgtgggccncaggcctcgaggcgaagggggctgggagtgggtgctactttagtttggatggataggaaaagtaaagaatactaatgacagtacggtcgaggtaacggccgtattacaccactcctaccaagaacgaacctaaacttaccaaacaacacgtacttcgtttacagaacaaatgaaaccagacctagacgacgaccggaggaacacggctagttcgtaatcacgttggttacgtaacgagaacgacgtcgggaccggtaacgggttcccgtttaacccg

SEQ ID NO: 321499 - DNA, 553 bp, Homo sapiens
  misc_feature: GZ8MTXP01DEYAK.4.25.C03.1.454.CMB.2.raw
  modified_base (315)..(315): a, c, t, g, unknown or other
  misc_feature (315)..(315): n is a, c, g, or t
  modified_base (342)..(342): a, c, t, g, unknown or other
  misc_feature (342)..(342): n is a, c, g, or t
  modified_base (497)..(497): a, c, t, g, unknown or other
  misc_feature (497)..(497): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtgcacttatttggatgatggaagtaagaaatactatgacagagtccgtgaaggccgattcaccatctcaganacaatccaaacaacacgctgtttcccngacaaatgaacaagcctgagagccgaggacacggctgtgtatcactgtgtacagagatcggccggagggccggttacccctcgttcgggggtttcccttcggactagttatcggtatggtaacgtcgtggggcctagggctaacggtcaccgtcncgtcacgccttccaccgtaagggcccaagtccggtccttcccctggccctaacccc

SEQ ID NO: 321500 - DNA, 558 bp, Homo sapiens
  misc_feature: GZ8MTXP01AL81A.4.25.C03.1.454.CMB.2.raw
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaagggggctgggagtggggtggctacttatttggtatgatggaagtaagaaatactatgcagagtccgtgaagggccgattcaccatctccagagacaattccaacaacacgctgtttccagcaaatgaacaagcctgagagccgaggacacggctgtgtatcactgtgtcaggagatcggccggaggggtccggttacccctcgtcgggggtttccttcgactagttagtggtatggacgtcgtgggggacctaggggctcggtcaccgtcttcctcacgccttccaccgaagggcccaagtcccggtccttccccgtggccctaacccc

SEQ ID NO: 321501 - DNA, 608 bp, Homo sapiens
  misc_feature: GZ8MTXP01BF3CR.4.25.C03.1.454.CMB.2.raw
  modified_base (532)..(532): a, c, t, g, unknown or other
  misc_feature (532)..(532): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtcgtgggggaggcgttgtccagcctgggaggtccctgagactctcctgtgcagcgtctgcattcaccttcaggagctatgggatgcacgtgggtccgccaggctccagggcgaagggggctgggaggtggggtggctactttagtttggtatgagtaggaaagtaagaaatactatgacagagtccgtagaaggccgattcaccatctcagagacaattccaaacaacacgtctgtttccagacaaatgaaacaagcctgaacgacgccgaggacacgggctagtgtatcactgtgtacgagagagtcggaccggacgggtccggttacccctgttacggggttcccttacgacgtagttactggtatgggtacgtcgtcgggggctacgggcgtaacggtccttaccggtcncccgtcaccgcccttccgaccgaaaccgggtcccaacgttcccggtccttacccccgtcggttcccgtaacccccg

SEQ ID NO: 321502 - DNA, 587 bp, Homo sapiens
  misc_feature: GZ8MTXP01ESROM.4.25.C03.1.454.CMB.2.raw
  modified_base (306)..(306): a, c, t, g, unknown or other
  misc_feature (306)..(306): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtcgtgggggagcgttgtccagcctgggagtccctgagactctcctgtgcagcgtctgcattcaccttcaggagctagtgggatgccacgtggggtcccnccaggcctccgagggcgaagggggctggggagttgggtggctacgtttagtttgggtatggaatagggaaaagttaaagaattactaagtgacaagtaggtcccgtagaacgggccgattcgaccactctacccagagaaccaacttacccaaacaacaccgtcttcgtttcagactaaatcgaaacagcctaggacgagcccggaggaaccacggctgttgtactcacgttgttgtaacagaacgagtcggaccggtaacgggttccccgtttaaccccg

SEQ ID NO: 321503 - DNA, 613 bp, Homo sapiens
  misc_feature: GZ8MTXP01CR66C.4.25.C03.1.454.CMB.2.raw
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgcttcttttaagaggtgtccagtgtcacgtgcgcctggtggagtcgtgggggagcgttgtccagcctggggacgtccctgagctctcctgtgcagcgtctgcattcaccttcaggnctagngggatgcacgtggggtccncgaggctccgaggcgaagggggctgggagtgggtgctagtttagtttggtatggataggaaaaataaagaattactagtgacaggagtccgaggacggcatcacatctacagagacaacttaccaacaacacgtcgttcgtttactagactaaagtcgaaaccgagacccgtaggaacggacgacccgggaaggaaccgtaacggcgttggttacgttaacgtaccgttaccgttggttacggttaaccgaaggtaacggtacggttccgggacccgggtaacggggttccccgggttttaacccccg

SEQ ID NO: 321504 - DNA, 538 bp, Homo sapiens
  misc_feature: GZ8MTXP01BLEJ3.4.25.C03.1.454.CMB.2.raw
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtgcacttattggatgatggaagtaagaaatactatgcagagtccgtgaagggccgattcaccatctccagagacaattaccaacaacacgctgtttcctgacaaatgaacancctgagagccgaggacacgggctgtntagtcactgtgtcagagatcgcgagggccggttaccctcttcggggttccttcgactagttactggtagtggacgtcgtggggctgggctaacggtcacgtcttcgtcacgcccttcaccgaacgggcccaatccggtcttcccctgccctaacccc

SEQ ID NO: 321505 - DNA, 784 bp, Homo sapiens
  misc_feature: GZ8MTXP01BZLVQ.4.25.C03.1.454.CMB.2.raw
  modified_base (216)..(216): a, c, t, g, unknown or other
  misc_feature (216)..(216): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctggggggaggcgttgtccagcctgggaggtccctgagactctcctgtgcagcgtctgcattcaccttcaggagctatgggatgcacgtgggtccnccaggctccgaggcgaaggggctgggagtgggtgctactttagttggatgagtggaaagtaagaaatactatgacaggacgtccggtaggaacgggcctattccaacatacctacaagaacgaacaacttaccaaacaacgacgtcttcgtttacctagacaaagtacgaaacaacgcccgtaaggaacggacgacccggaagggaaccgacgggtcttaggtacgttactacgtaacgttgggttacgtacgaaagggtaggtaaacgttccggggaccccggggtaacgggggttaccccggtttaacccccgttcggtttccgggggtttacccgtttaaccggaccgttaaggtttacggtaggggttacgttacggggtacccggtttcggggtaccgggggtacccgttaacgggggacccgttaaccggggtcccgttaccccggttcccttacccggtccgtaaccggttccccttaccccgaaccggaacccggggtccccctaacgttcccccggggttccccttcccccccgggtcggaacccccgttaaccccccg

SEQ ID NO: 321506 - DNA, 576 bp, Homo sapiens
  misc_feature: GZ8MTXP01A79WE.4.25.C03.1.454.CMB.2.raw
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagcttgggttttcctcgttgctcttttaagaggtgtccagtgtcacgtgcgcctggtggagtcgtgggggagcgttgtccagcctgggagtccctgagactctcctgtgcagcgtctgcattcaccttcagganctagtgggatgcacgtcggggtcccnccgaggcctccgagggcgaagggggctgggagtggggtggctacgtttagttggtatggatagggaaaagtaagaatactatgacagacgtccgtagaacgggcatcacatctacagagaacaacttaccaaacaacacgtcttagttctagacaaatcgaacagacctgacgacgacccgaggaaccacggctagttgtaactcgacgttggttagtcgaaggtaacgagtcgggacccgggtaacggggttccccggtttaaccccg

SEQ ID NO: 321507 - DNA, 638 bp, Homo sapiens
  misc_feature: GZ8MTXP01ANIQT.4.25.C03.1.454.CMB.2.raw
  modified_base (214)..(214): a, c, t, g, unknown or other
  misc_feature (214)..(214): n is a, c, g, or t
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccnccaggctccaggcaagggggctgggagtgggtgctacttattggtatgatggaagtaagaaatactatgcagagtccgtgaaggccgattcaccatctccagagacaattccaaanaacacgcttgtttccngacaaatgaacagcctgagagccgaggacacgggctgtgtatcactgtgtcagagagtcggccgtacggggccggtttaccccgtcgttcgggggttcccttacggactaggtttatgggtacgtcgggaacgttccggtacgggggtccgttaagggggtcccttaacgggggttcccacccgggttccttcccgtaccgtaaccgttccccgttcccgaacccggtaaaccggggcccctaacgttcccggggttcccctttccccccgcgggttccccttaaccccccg

SEQ ID NO: 321508 - DNA, 628 bp, Homo sapiens
  misc_feature: GZ8MTXP01COKKP.4.25.C03.1.454.CMB.2.raw
  modified_base (287)..(287): a, c, t, g, unknown or other
  misc_feature (287)..(287): n is a, c, g, or t
  modified_base (347)..(347): a, c, t, g, unknown or other
  misc_feature (347)..(347): n is a, c, g, or t
  modified_base (553)..(553): a, c, t, g, unknown or other
  misc_feature (553)..(553): n is a, c, g, or t
  modified_base (612)..(612): a, c, t, g, unknown or other
  misc_feature (612)..(612): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcacgtgggtccgccaggctccgaggcaagggggctgggaggtggggtggctactttagttggtatgatggaaagtaagaaatanatgcagagtccgtgaaggccgatcacatctcagagacaatccaacaacacgctgtttccngacaaatgaacacgctgagacgccgagacgacgggctagtgtatcacttggtcgtacgagagtatcgggaccggtacggggtcccggtttacccctcggttcgggggtttccctttacggaaccttaggtttaacgtggggttaagtcggggtaaccggttcggtcgggggaccttagggggcccttaacgggtccaccggttccncccgttacgacgttccccgttcccaaccgaacgggcccctaagtcccggtccttccccncggttcctaacccccg

SEQ ID NO: 321509 - DNA, 523 bp, Homo sapiens
  misc_feature: GZ8MTXP01DUY5R.4.25.C03.1.454.CMB.2.raw
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtctgggggagcgttgtccagcctgggaggtccctgagactctcctgtgcagcgtctgcattcacttcaggagctatgggatgcacgtggggtccncaggctccgaggcaagggggctgggagtgggtggcacttatttggatgaatggaaaattaagaattactatgcagngtccgtgaggcattcacatctacaganacaattccaanaacacgcttgtttctagacaaagtcgaacagacctgagacgccgnggaacncggctgttgtatcacgttgttcgtnagngagtgccggtaacggccggtttaacccc

SEQ ID NO: 321510 - DNA, 773 bp, Homo sapiens
  misc_feature: GZ8MTXP01EMBNN.4.25.C03.1.454.CMB.2.raw
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccgaggcgaaggggctggagtgggtgctattattggatgataggaaagtaaagaaatacgtatgacgagtacgtccggtaggaacgggccgtaattcaacctatcctaccaaggtacgaacctaaatttacccaaaactaacaacgtcttacggttttaccacggaacaaagtcgaaacaacggcctggaagaccgggacccggaaggaccacgggcttagtgttaactacgtacgttggtacgtacgaaggtaacggtacgtaccggggacccgggtacggggttaccccggttttaaccccgttcggttttaccgggggtttacccgtttaacggtaaacgttaaggtttacgtacggggttacggttacggggttaccggttcgggtaccgggggtaccggttaaccgggggtacccgttaaccggggtcccttaacccggttccttcccgtaccggtacccgttaccccgttaccccggaaacccggtaacccgggtccctaacggttccccggtaccccttcccccggtaacgttcccctaaccccg

SEQ ID NO: 321511 - DNA, 599 bp, Homo sapiens
  misc_feature: GZ8MTXP01ADAY9.4.25.C03.1.454.CMB.2.raw
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (309)..(309): a, c, t, g, unknown or other
  misc_feature (309)..(309): n is a, c, g, or t
  modified_base (554)..(554): a, c, t, g, unknown or other
  misc_feature (554)..(554): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagcttgggttttcctcgttgcttcttttaagaggtgtccagtgtcacgtgcgcctggtggagtcgtgggggagcgttgtccagccgtggggacgtccctgagctctcctgtgcngcgtctgctattcaccttnagganctagtgggatgcacgtgggtcccncaggcctccgaggcgaagggggctgggagtgggtgctacgtttagttggtatggaagtggaaaaaagtaacgaattactagtgacaggtacgtaccggtaggaacgggtctaattccacctatctaccgagtacaactaacttaccaaacaactacgcgttggtttaccagaaccaaatcgaacaggcctaggacgacgccggaggaacacgggttctagttgttaactccgacgttgttcgaanagaacgtacgtcgggacccggtaacggggttcccgtttaaccccg

SEQ ID NO: 321512 - DNA, 626 bp, Homo sapiens
  misc_feature: GZ8MTXP01EXR3J.4.25.C03.1.454.CMB.2.raw
  modified_base (350)..(350): a, c, t, g, unknown or other
  misc_feature (350)..(350): n is a, c, g, or t
  modified_base (407)..(407): a, c, t, g, unknown or other
  misc_feature (407)..(407): n is a, c, g, or t
  modified_base (556)..(556): a, c, t, g, unknown or other
  misc_feature (556)..(556): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatggatgcactgggtccgccaggctccagggcaagggggctgggaggtggggtggctactttatttggtatgatggaagtaaagaaatactatgcagagtccgtgaagggccgattcaccatctccagagacaatccaacaacacgctgtttccngacaaatgaacaagcctgagagccgaggacacgggctgtgtatcactgtgtcgaagngatcggccggacgggtcccggtttacccctcgttcggggttccttacggaccgtagtttaagttgggttaagtcggggtaccggttcggtcgggggtaccctagggggtaccgttaacgggtccttacccggttccttcccgtaccgcnccccgttcccgacccgtaacggggcccctaacgttcccgggtccctttcccccgtcggccctaacccccg

SEQ ID NO: 321513 - DNA, 694 bp, Homo sapiens
  misc_feature: GZ8MTXP01CAMGW.4.25.C03.1.454.CMB.2.raw
  modified_base (195)..(195): a, c, t, g, unknown or other
  misc_feature (195)..(195): n is a, c, g, or t
  modified_base (217)..(217): a, c, t, g, unknown or other
  misc_feature (217)..(217): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctggggggaggcgttgtccagcctgggaggtccctgagactctcctgtgcagcgtctgcattccaccttcagganctatgggatgcacgtgggtccnccaggctccgagggcgaagggggctgggaggtggggtggctacgtttagtttggtataggagtagggaaagtaaagaaatactatgacaggagtccggtaggaacgggccgtaattccaccatcctaccgagaagaccaaattaccaaacaactacgcttgtttcccagacaaagtcgaacaagccctgacgacgccggaagaccgacgggtctgtagtatcacgtgtgtacgaagagtagtcggaccggtacggggtcccgtttaaccccgtcgttccgggggtttcccttacggaacgttacggtttagttcggggttagtcgggtaacgttccggtcgggggtaccgttacggggaccgttaaccgggtccacccggttccttacccgtaccgaccggttcccttaccccgaccgaacccggggtcccctaacggttccccggtacccgttcccccgtcggcccctaacccccg

SEQ ID NO: 321514 - DNA, 598 bp, Homo sapiens
  misc_feature: GZ8MTXP01EDWWN.4.25.C03.1.454.CMB.2.raw
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (311)..(311): a, c, t, g, unknown or other
  misc_feature (311)..(311): n is a, c, g, or t
  modified_base (470)..(470): a, c, t, g, unknown or other
  misc_feature (470)..(470): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagcttgggttttcctcgttgcttcttttaagaggtgtccagtgtcacgtgcgcctggtggagtcgtgggggagcgttgtccagccgtggggacggtccctgagctctcctgtgcagcgtctgcattcacttnaggtanctagtgggatgcacgtcggggtcccncgaggctccgaggcgaagggggctgggaggttgggtgctagtttagttggtatgataggaaaaataacgaatctatgactaggacgtcgtagaaggcatcacatcacagacgactaataccaaacactacgtcttgtttacagaacaaagtcgaaaccngacgtaggaacgacggaccggaaggaaccgtacggttcttaggttacgtactcgttacgttggttacgtaacgaaggtaacgtacgggtccgggacccggggtaaccgggtttccccggtttaacccg

SEQ ID NO: 321515 - DNA, 647 bp, Homo sapiens
  misc_feature: GZ8MTXP01CP0W3.4.25.C03.1.454.CMB.2.raw
  modified_base (320)..(320): a, c, t, g, unknown or other
  misc_feature (320)..(320): n is a, c, g, or t
  modified_base (345)..(345): a, c, t, g, unknown or other
  misc_feature (345)..(345): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcacgtgggtccgccaggctccaggcgaagggggctgggagtgggtggctattagtttggtatgatggaaagtaagaaatactatgcagagtccgtagaaggcgatcacatcacaganacaatccaacaacacgctgtttccngacaatgaacagctgagacgacgagacacgctgtcgtatcacgtgtgtacgagtaagagtcggaccggacggggtcccggttaaccccgttcgttcgggggtttaccctttacgaacgtaggtttaagtcgggttaagtggggtaacgttcggtggggtacccgtaaggggaccgttaaccggggtccttacccgggttccttccgttaccgacgttaccccttcccgaacccggaaccgggggtcccctaacggtttccccggtacccgttttccccccgtcgggttccccttaacccccg

SEQ ID NO: 321516 - DNA, 575 bp, Homo sapiens
  misc_feature: GZ8MTXP01EQW1M.4.25.C03.1.454.CMB.2.raw
  modified_base (350)..(350): a, c, t, g, unknown or other
  misc_feature (350)..(350): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtcgtgggggaggcgttgtccagcctggggaggtccctgagactctcctgtgcagcgtctgcattcaccttcaggagctatgggatgcactgggtccgccaggctccgaggcaagggggctgggagtgggtggctacttatttggatgatggaaagtaagaaatactatgcagagtccgtgaaggccgattcaccatctacagagacaattccaaacaacacgctgtttccngacaaatgaacaagcctgagagccgagacacgggctgtgtatcactgtgtcagagatcggccggagggtccgttacccctgttacgggggtttccttcggactagttagtggtagtgggtacgtcgtgggggacctaggggcctaacggtccaccggtcttcctcgacgcccttccaccgaacgggccctaagtcccggtcccttccccgtcggccctaaccccg

SEQ ID NO: 321517 - DNA, 699 bp, Homo sapiens
  misc_feature: GZ8MTXP01D37JE.4.25.C03.1.454.CMB.2.raw
  modified_base (264)..(264): a, c, t, g, unknown or other
  misc_feature (264)..(264): n is a, c, g, or t
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
  modified_base (342)..(342): a, c, t, g, unknown or other
  misc_feature (342)..(342): n is a, c, g, or t
tcagagcactgtagcacgaccggtgctcgatttagtagtgtagatttgggtttggggctggggagaggagcccagcactagaagtcggcggtgtttccattcggtgatcagcactgaacacagaggactcaccatggagtttgggctgagtcgttgggttttcctcgttgcttcttttaagaggtgtccagtgtcacgtgcgctggtggagtcgtgggggagtcgttgtccagccgtggggagtccctgagactctcctgtgcngcgtctgctatcacctgagganctagtggatgcacgtcgggccncgaggcctacgaggcgaagggggctgggagtggngctactttagttggatgaataggaaaaagtaaacgaatacgtaagtcggacgtaaggtacggtacccggtaagggaacggggtcctaagttacaaacccgtattacccgtaccgaaaggacgtaaacccaaaacttaccccgaaaaccaaaccgtaaaccggttcctttacgggttttacctaagggtaaaccctaaaagtaacgtaaacgaaccgaccgttacggtaacggaacggaaccggaacgggaacgaacggttaccgtaggttacggtactaccgttaacgttcgttacgttaacgaggtaaggtacggtacggaccgggtaaccgggttaacccgggtttaacccccgg

SEQ ID NO: 321518 - DNA, 672 bp, Homo sapiens
  misc_feature: GZ8MTXP01ESACL.4.25.C03.1.454.CMB.2.raw
  modified_base (353)..(353): a, c, t, g, unknown or other
  misc_feature (353)..(353): n is a, c, g, or t
tcagagcactgtagcacgaccggtgctcgatttagtagtgtagatttgggtttgggctgagctgggttttcctcgttgctcttttaagaggtgtccagtgccacgtgcgcctggtggagtcgtgggggaggcgttgtccagcctgggaggtccctgagactctcctgtgcagcgtctgcattcaccttcaggagctatgggatgcacgtgggtccgccaggctccgaggcgaagggggctgggaggtgggtggctacttagtttggatgatggaaagtaagaaatactatgcagagtccgtgaaggccgattcacatctaccagagacaattccaaacaacacgctgtttccngacaaatgaacagcctgagagcgagacgacggctgtgtatcactgtgtacgagagtatcgggccggtaacggggtcccgttaaccccgttcgttcggggtttcccttacggtaaccgttaaggtttagtagggttacgttcgggaacggttcggtacgggggtacccgttacggggacccgttaaacggggttcccaccccgggtttccttccccgtaccgtaacgggttcccccttacccgaaccccggaaccggggtcccctaacggtttccccgggttcccctttaccccccgtgggttcccccttaaccccccgg

SEQ ID NO: 321519 - DNA, 813 bp, Homo sapiens
  misc_feature: GZ8MTXP01BQW2U.4.25.C03.1.454.CMB.2.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtcgtggggggagcgttgtccagcctgggaggtccctgagactctcctgtgcagcgtctgcattccaccttcgagganctagtgggatgcacgtgggtccncaggcctccgaggcgaagggggctgggacggtgggtgctacgtttagtttgatggataggaaagtaaagaaatactagtcgacgtaaggacgttccggtaggaacgggtccctaattaccgaacctactacctaccgaaagtaacgaacccttaaacttaaccccaaaacctaaccgtaaccgtcgtttacgttttacccgacggtaacctaaaagtacgaaaccctaacggacccgtaaggacggaaccgggaccggaacggaccgtacggtcttaggtagtaactcgaacgttcgtagtacgaaagggacgtacgtaccgggacccgggttacggggttaccccgttacccttcgggtttaaccgggtttcgttaacggtaacgtttaaggttacggttacggttaacgggtcgggtacccgggtttcggggtaccggggttacccggtaacggggtacccgttaaccgggtacccttacccgggttcccttaaccgtaccgtaacccgttccccgttaacggaacccggtaaccgggtcccctaacggtttcccccggtcccttaccccggtccgttaaccctaacccccg

SEQ ID NO: 321520 - DNA, 762 bp, Homo sapiens
  misc_feature: GZ8MTXP01CVTW2.4.25.C03.1.454.CMB.2.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (316)..(316): a, c, t, g, unknown or other
  misc_feature (316)..(316): n is a, c, g, or t
  modified_base (352)..(352): a, c, t, g, unknown or other
  misc_feature (352)..(352): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtcgtgggggaggcgttgtccagcctgggaggtccctgagactctcctgtgcagcgtctgcattcaccttcagganctagtgggatgcacgtgggtccnccaggctccgaggcgaaggggctgggagtggggtgctagtttagttgtatgatggaaagtaagaaatactatgacagagtccgtgaaggccgattcacntctacagagacaatccaaacaacacgctgttttccngacaaatgaaacagcctgagaacgccgaggacacggctgtagtactcacgtgttacgacaaggtacggaagttcgggaccccggttacgggggtaccccggttttaacccccgtccgggtttcgggggtttaccccctttacggggtaaacccgtttaagggtttaaaccgttggggttaaacgtttccgggggtaaacccggtttccggggttaccggggggtaccccgtttaaacggggggtacccgtttaaacccggggttcccgttaaaccccgggttcccttcccgttacccgaaccgttccccccggttacccaaaccccggggaaacccgggtcccccgtaaccggtttccccggttcccccggtttacccccccgtcgggttaaccccccgttaaccccccg

SEQ ID NO: 321521 - DNA, 876 bp, Homo sapiens
  misc_feature: GZ8MTXP01D40RS.4.25.C03.1.454.CMB.2.raw
  modified_base (217)..(217): a, c, t, g, unknown or other
  misc_feature (217)..(217): n is a, c, g, or t
  modified_base (858)..(858): a, c, t, g, unknown or other
  misc_feature (858)..(858): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtcgtgggggagcgttgtccagcctgggaggtccctgagactctcctgtgcagcgtctgcattccaccttcaggagctagtgggatgcacgtgggtccnccaggctcgaggcgaaggggctgggagtgggtgactaattagttggatgataggaaagtaaagaaatactatgacaaggtacgtaccggtaggaacgggtcctaatttccgaacctacgttacctaccgaaaggaacgtaaccctaaaactttaaccccgaaaactaaaccgtaaccgttccgtttacggttttaccccaacggtaaacctaaaaagtacggaaaaccctaacgggtacccgttaaggggaaaccgggtaaacggggaccccgggtaaaacggggaacccgggtaaccggggtacgtttaggttacgttaacttacgtaaccggttgggttacgttaaccgaaagggtaagtaacggttccggggaacccgggttaaccgggggttccccgtttaaccccccgttgggttttaccggggttttacccgttaacggtaaaccgttacggttttaacggtgggttaacgttacggggtaaccgggtttccggtacggggggtacccgttaaacggggtcccgttaaccgggtacccttacccgggttccttccccgaacgtcccgttacccccgttccggaaacccggtaacgggtcccctaacggtttccccggtacccctttcccccgggngttcccccgtaacccccg

SEQ ID NO: 321522 - DNA, 768 bp, Homo sapiens
  misc_feature: GZ8MTXP01BSLM5.4.25.C03.1.454.CMB.2.raw
tcagagcactgtagcacgaccggtgctcgatttagtagtgtagatttgggtttgggctgagctgggttttcctcgttgctcttttaagaggtgtccagtgtcacgtgcgcctggtggagtcgtggggggaggcgttgtccagcctgggaggtccctgagactctcctgtgcagcgtctgcattcaccttcaggagctagtgggatgcacgtgggtccgccaggctccgaggcgaaggggctgggaggtgggtgctattagtttggatgagtaggaagtaaagaaatactatgacgagacgtccggtaggaacgggcctatccacctactcaccgagacgtaactaacttaccaaacaactacgtcttacgttttccacgtaactaaagtacgaaccgaaacgtcccgtaaggaacgacgggacccgggaacggaaccgacgggtcttggttacgttactaccgtaacttggtagttacgaaggacgtacgtccgggacccgggtacgggtaccccggtttaaccccgttcggtttaccggggtttacccgtttcggtaaccgtttaaggtttacgtggggttacgtacggggtaccggttccgggtacgggggtacctaaccgggggtacccgttaaccggtccgttacccgttccgttcccgttaccgaccgttccccgaccccgaacccggtaacccggggtccccttaaccgggttcccccggtttaccccgttccccccggtaaccggttccccctaacccccg

SEQ ID NO: 321523 - DNA, 669 bp, Homo sapiens
  misc_feature: GZ8MTXP01BCM8L.4.25.C03.1.454.CMB.2.raw
  modified_base (216)..(216): a, c, t, g, unknown or other
  misc_feature (216)..(216): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctggggggaggcgttgtccagcctgggaggtccctgagactctcctgtgcagcgtctgcattcaccttcaggagctatgggatgcacgtgggtccnccaggctccgaggcaagggggctgggagtggggtgctactttagttggtatgataggaaagtaagaaatactatgacagacgtccgtggaagggccgtattccaccatcctaccaagacgaaccaaacttacccaaacaaccacgtcttgttttcccaggtacaaatcggaaacaacgcctggacgacgacccgggagaccacgggcttgtagtactcaacgtgtagtcgaagaggactcgggaccgggtacgggtcccgttacccttcgtacggggtttccctacgactaggttagtcggtagtcgggtacgttcgggtacgggggtacctacggggtacgtaaccgggtcccacccggttccttacccgtccgaaccgccccgttccgaaccccggtaacgggcccctaacgtcccggttcccttcccccgcggttaacccctaacccccg

SEQ ID NO: 321524 - DNA, 524 bp, Homo sapiens
  misc_feature: GZ8MTXP02JLARA.4.25.C03.1.454.CMB.2.raw
  modified_base (356)..(356): a, c, t, g, unknown or other
  misc_feature (356)..(356): n is a, c, g, or t
  modified_base (408)..(408): a, c, t, g, unknown or other
  misc_feature (408)..(408): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtccggggaggcgttgtccagcctgggaggtccctgagactctcctgtgcagcgtctgcattcaccttcaggagctatgggatgcactgggtccgccaggctccaggcaaggggctggagtgggtggcacttattggtatgatggaagtagaaatctatgcagagtccgtgaagggccgattcaccatctccagagacaattccaacaacacgctgttctgcaaatgaaacagcctgngagccgaggacacggctgtgtatcactgtgtcagagatgcgaggcgtacccntggttcctgacagttatggtatggacgtcgtggggcctagggactacggtcaccgtctccgtcacgcctccaccaacgggcccagtccggtccttcccccgtggccctaccctccc

SEQ ID NO: 321525 - DNA, 581 bp, Homo sapiens
  misc_feature: GZ8MTXP02GW7JI.4.25.C03.1.454.CMB.2.raw
  modified_base (214)..(214): a, c, t, g, unknown or other
  misc_feature (214)..(214): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccnccaggctccaggcaaggggctggagtggggtggcacttattggtatgatggaagtaagaaatactatgcagagtccgtgaagggccgattcgaccatctccagagacaattccaacaacacgctgtttcctgacaaatgaacagcctgagagccgaggacacggctgtgtatcactgtgtcagagatcgccggagggccggttacccctgttacggttcccttcggactacggtttatcgggttaatgggtaaccggtcgtacgggggcccgtaaggggaccttacgggtcctacccggtcctccgtacacgtccctccaaccgaacgggccctacgtccggtccttcccccgtcggccctaccccg

SEQ ID NO: 321526 - DNA, 541 bp, Homo sapiens
  misc_feature: GZ8MTXP02HDO5N.4.25.C03.1.454.CMB.2.raw
  modified_base (214)..(214): a, c, t, g, unknown or other
  misc_feature (214)..(214): n is a, c, g, or t
  modified_base (312)..(312): a, c, t, g, unknown or other
  misc_feature (312)..(312): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccncaggctccaggcaaggggctggagtgggtggcattattggtatgatggaagtaagaaatactatgcagagtccgtgaagggccattcacatctcaganacaattccaaacaacacgctgtttcctgcaaatgaacagcctgagagcgagacacggctgtgtatcactgtgtcagtacgatgccgagggccggttaacccctcgttcggttccttcgactagttactggtatcggacgtcgtggggtcctagggactacggtccaccgtcctcctcacgcctccgaccgaacggcccacgtccggtcctccccctcggacctaccccc

SEQ ID NO: 321527 - DNA, 600 bp, Homo sapiens
  misc_feature: GZ8MTXP02HFZPR.4.25.C03.1.454.CMB.2.raw
tcagagcactgtagcacgaccggtgctcgatttagtagtgtagatttgggtttgggctgagcgtgggtttcctcgttgctctttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttattggtatgatggaaagtaagaaatactatgcagagtccgtagaaggccgattcaccatctccagagacaattccaaacaacacgctagttcctgacaaatgaacagctgagagccgagacacggctgtagtatcactggtgtcaagagatcggcccggtaggggtccggtttaaccccctgttcgggttcccttacggactagggtttatgggtatcgggggacttcggtggggcccgttaaggggaccttaacggggtccctaaccggtcttccctcgaccgtccgtacccgaccgaaccggtacccgtaccgtccggttcccgttccccgtccgtacccgtaccccg

SEQ ID NO: 321528 - DNA, 647 bp, Homo sapiens
  misc_feature: GZ8MTXP02GW4T8.4.25.C03.1.454.CMB.2.raw
  modified_base (214)..(214): a, c, t, g, unknown or other
  misc_feature (214)..(214): n is a, c, g, or t
tcagagcactgtagcacgaccggtgctcgatttagtagtgtagatttgggtttgggctgagcgtgggtttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccnccaggctccgaggcaaggggctggagtgggtgctacttagttggtatgatggaagtaagaaatactatgcagagtccgtgaaggccgattcacatctcagagacattccaacaacacgctgttctgacaatgaacagcctgagagccgagacacggctgtgtatcagtgtgacgagagagtcggaccgacggggtcccggttaccctcgttcgggttccctttacgacttaggtttaagtgggttaagtcgggtaacgttcggtcgggggtccgtaaggggtaccgttaaccggtccgtacccggttccgtacccttccgtaacccgcccccttacccgtaaaccccgggaaaaccgggggtccccctaaacgggtttccccggggttaccccctttacccccccgttacggggccccctttaaacccccccg

SEQ ID NO: 321529 - DNA, 545 bp, Homo sapiens
  misc_feature: GZ8MTXP02H44HJ.4.25.C03.1.454.CMB.2.raw
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (442)..(442): a, c, t, g, unknown or other
  misc_feature (442)..(442): n is a, c, g, or t
tcagagcactgtagcacgaccggtgctcgatttagtagtgtagatttgggtttgggctgagctgggttttcctcgttgctctttaagaggtgtccagtgtcacgtgcgcctggtggagtctgggggaggcgttgtccagcctggggaggtccctgagactctcctgtgcagcgtctgcattcaccttcaggagctatggggatggcactgggtccgccaggctccaggcaagggggctgggagtggggtggctacttattggtatggatggaagtaagaaatactaatgcagagtccgtgaagggccgattcaccatctccagagacaattccaaanaacacgctgttccngcaaatgaacagcctgagagccgagacacggctgtgtancactgtgtcaganatgacgaggcgtaccctgttcggttcttcgacagttacnggtatggtacgtgtggggcagggtactacggtcaccggtctcctcacggcctaccgaccgaacgggccctaacgtccggtccttccccgtggaccctaccccg

SEQ ID NO: 321530 - DNA, 613 bp, Homo sapiens
  misc_feature: GZ8MTXP02I6TLV.4.25.C03.1.454.CMB.2.raw
  modified_base (216)..(216): a, c, t, g, unknown or other
  misc_feature (216)..(216): n is a, c, g, or t
  modified_base (604)..(604): a, c, t, g, unknown or other
  misc_feature (604)..(604): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctggggggaggcgttgtccagcctgggaggtccctgagactctcctgtgcagcgtctgcattcaccttcaggagctatgggatgcacgtgggtccnccaggctccgaggcaaggggctgggagtgggtgctacttagttggtatgataggaagtaagaaatactatgcagagtccgtagaaggcatcacatctcagagacaataccaaacaacacgcttgtttcctagacaaatgaacagcctgagacgaccggaagacacggctgtagtatccatgtgtacgagagatcggccggacgggtcccgttaccccgtgttacggtttcccgttcgaactaggttagtgggttaatcgggtacggttcggtcgggggacccgttaagggaaccttaacggacttaccgtaacccggttcctacccgtaccgaaccgtcccctaaccgaacccgaacgggcccctagtccccggttcccttcccccgnggtaccccc

SEQ ID NO: 321531 - DNA, 665 bp, Homo sapiens
  misc_feature: GZ8MTXP02HLUE9.4.25.C03.1.454.CMB.2.raw
  modified_base (214)..(214): a, c, t, g, unknown or other
  misc_feature (214)..(214): n is a, c, g, or t
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccnccaggctccaggcaaggggctgggagtgggtggctacttattggtatgatggaagtaagaatactatgcagagtcgtgaaggcgatcacanctccagagacaattccaaanaacacgcttgttccctgacaaatgaacagcctgagagccgagacacgctgtgtatcactgtgtacagagagtacgccggacgggtaccggtttaaccccgtcgttccggtttcccgtttacggaccgttaggtttaacgttgggttaaagttcggggtaacggttcggtcgggggtacccttaacgggggaaccgtttaaccgggtcccgtaaccccgggttccgttccccgttcctaaccgggcccccttaccccggaaaccccgaaaccgggggccccctaaccggttccccggggtaccccttttcccccccggcggggttacccctaacccccccg

SEQ ID NO: 321532 - DNA, 587 bp, Homo sapiens
  misc_feature: GZ8MTXP02FZABP.4.25.C03.1.454.CMB.2.raw
  modified_base (214)..(214): a, c, t, g, unknown or other
  misc_feature (214)..(214): n is a, c, g, or t
  modified_base (477)..(477): a, c, t, g, unknown or other
  misc_feature (477)..(477): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccnccaggctccaggcaaggggctggagtgggtggcacttattggatgatggaagtaagaaatactatgcagagtccgtagaagggccgattcaccatctccagagacaatccaaacaacacgctgttctgacaaaatgaacagcctgagacgaccgagacacggctgtagtatcactgtgtcagagatggccgaggggtccggtttacccctcgttcgggtttccccttcgaacgtaggtttagtaggttagtgggacgttcggngggggtaccctaggggacctaacgggtcacccggttctccttacacgtccctcccaaccgaaacggggtccccaagttcccggtcccttccccgtcggaccctacccccg

SEQ ID NO: 321533 - DNA, 530 bp, Homo sapiens
  misc_feature: GZ8MTXP02FN0Z9.4.25.C03.1.454.CMB.2.raw
  modified_base (157)..(157): a, c, t, g, unknown or other
  misc_feature (157)..(157): n is a, c, g, or t
  modified_base (322)..(322): a, c, t, g, unknown or other
  misc_feature (322)..(322): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctganacggggtctcctgtgcagcgtctgcattcaccttcaggagctatgggatgcactgggtccgccaggctccaggcaagggggctggagtgggtggcacttatttggatgatggaagtaagaaatactatgcagagtccgtgaagggccgattcaccatctccaganacaattccaaacaacacgctgttcctgcaaatgaacagcctgagagccgaggacacgggctgtgtatcactgtgtcagagatgccgagggcgttaccctctggttcccttgactagttatggtatggacgtcgtggggcctagggactacggtcacgtctctcacgcctcaccaaggcccagtccggtccttccccgcggcctacccc

SEQ ID NO: 321534 - DNA, 551 bp, Homo sapiens
  misc_feature: GZ8MTXP02GJ1D2.4.25.C03.1.454.CMB.2.raw
  modified_base (215)..(215): a, c, t, g, unknown or other
  misc_feature (215)..(215): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctggggggaggcgttgtccagcctgggaggtccctgagactctcctgtgcagcgtctgcattcaccttcaggagctatgggatgcactgggtccnccaggctccaggcaaggggctgggagtgggtggcacttatttggtatgatggaagtaagaaatactatgcagagtccgtgaagggccgattcacatctccagagacaattcaaacaacacgctgtcctttttgcaaatgaacagctgagagccgagacacggctgtgtatcactgtgtcagagagtgcgacggcggttacccgtttggttccttcgactagttatggtatggcgtcgtcgggctagggcgtacggtctaccggtctcctcaacgccctaccgaccaacgggcccgacgttccggtcccttcccccgtcggccctacccctaccccg

SEQ ID NO: 321535 - DNA, 554 bp, Homo sapiens
  misc_feature: GZ8MTXP02GI1Y4.4.25.C03.1.454.CMB.2.raw
  modified_base (507)..(507): a, c, t, g, unknown or other
  misc_feature (507)..(507): n is a, c, g, or t
tcagagcactgtagcacgaccggtgctcgatttagtagtgtagatttgggtttggggctgggagaggagcccaacactagaagtcggcggtgtttccattcggtgatcagcactgaacacagaggactcaccatggagtttgggctgagctgggttttcctcgttgctcttttaagaggtgtccagtgtcacgtgcgcctggtggagtcgtgggggaggcgttgtccagcctgggaggtccctgagactctcctgtgcagcgtctgcattcaccttcaggagctagtggggatgcacgtgggtccgccaggctccgaggcaaggggctgggagtgggtgctactttagtttggtatgatagggaaagtaagaaattactatgacagacgtccggtaggaaacgggccgattaccaccatcctaccagacgaacaacttaccaaacaacacgcttgtttactgacaaatgaaacagacctagacgagaccgaggacacggctgtgtanctacgtgtgtacgaagagagtcggaccggacgggtccgttaccctcg

SEQ ID NO: 321536 - DNA, 548 bp, Homo sapiens
  misc_feature: GZ8MTXP02HK015.4.25.C03.1.454.CMB.2.raw
  modified_base (214)..(214): a, c, t, g, unknown or other
  misc_feature (214)..(214): n is a, c, g, or t
  modified_base (537)..(537): a, c, t, g, unknown or other
  misc_feature (537)..(537): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccnccaggctccaggcaaggggctggagtgggtggcacttattggtatgatggaagtaagaaatactatgcagagtccgtgaagggccattcaccatctcagagacaattccaaacaacacgcttagtttcctgacaaatgaaacagcctgagagccgagggacacgggctgtgtatcactgtgtcagagatgccggacgggccggttacccctcgtcggttccttcgactaggttagtggtatggacggtcgtgggggcctaggggactacgggtcaccgtctcctcacgcctccaccaacgggcccacgtccggtccttccccncggcctacccc

SEQ ID NO: 321537 - DNA, 556 bp, Homo sapiens
  misc_feature: GZ8MTXP02G3D4O.4.25.C03.1.454.CMB.2.raw
  modified_base (504)..(504): a, c, t, g, unknown or other
  misc_feature (504)..(504): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaagggggctgggagtgggtggcacttattggtatgatggaagtaagaaatactatgcagagtccgtgaagggccgattcaccatctccagagacaattccaaacaacacgcttgtttccctgacaaaatgaaacagcctgagagccgaggacacggctgtgtatcactgtgtacagagatcggaccggaggggccgtttacccctgttcggttcccttcgactagttacgtggtatgggacgtcgtggggcctagggactacggtcaccggtctccncacgccctccaccgaacggccctagtccggtcctccccgtggccctaccccg

SEQ ID NO: 321538 - DNA, 597 bp, Homo sapiens
  misc_feature: GZ8MTXP02F0FL5.4.25.C03.1.454.CMB.2.raw
  modified_base (214)..(214): a, c, t, g, unknown or other
  misc_feature (214)..(214): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccnccaggctccaggcaaggggctggagtgggtggcacttattggtatgatggaagtaagaaatactatgcagagtccgtgaaggccgattcaccatctccagagacaattccaaacaacacgctgtttcctagcaaatgaacagctgagagccgaagacacggctgtgtatcactgtgtcagagatggacccggagggcccggtttaaccccctgttcggtttacccgttcgaacctaaggtttagtcggttaagtcgggaccgttcgtcgggggtaccttaacgggggaccttaacggggtccacccggtttctacccgttcgacgtccctcccgaaccgaaacgggcccctaagtcccggtcctcccccgtggccctaccccc

SEQ ID NO: 321539 - DNA, 547 bp, Homo sapiens
  misc_feature: GZ8MTXP02HLSJM.4.25.C03.1.454.CMB.2.raw
  modified_base (214)..(214): a, c, t, g, unknown or other
  misc_feature (214)..(214): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccnccaggctccaggcaagggggctgggagtgggtggcacttatttgggtatgatggaagtaagaaatctatgcagagtccgtgaaggccgattcaccatctccagagacaattccaacaacacgctgttccctgacaaatgaacagcctgagagccgaggacacgggctgtgtatcactgtgtcagagatgccgagggccgttaccctcgttcggttccttcgactagttatggtatggacgtcgtggggcctaggggtactacggtcaccggtctcctcgacgccctaccaccgaacgggcccacgtccggtcctccccctcggccctaccccg

SEQ ID NO: 321540 - DNA, 527 bp, Homo sapiens
  misc_feature: GZ8MTXP02HUXO8.4.25.C03.1.454.CMB.2.raw
  modified_base (305)..(305): a, c, t, g, unknown or other
  misc_feature (305)..(305): n is a, c, g, or t
  modified_base (387)..(387): a, c, t, g, unknown or other
  misc_feature (387)..(387): n is a, c, g, or t
  modified_base (457)..(457): a, c, t, g, unknown or other
  misc_feature (457)..(457): n is a, c, g, or t
  modified_base (493)..(493): a, c, t, g, unknown or other
  misc_feature (493)..(493): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtctgggggagcgttgtccagcctgggaggtccctgagactctcctgtgcagcgtctgcattcaccttcaggagctagtgggatgcacgtggggtcccnccgaggcctccgaggcgaaggggctgggagtggggtggctacgtttagtttggtatgagtggaaagtaagatactatgcagngtcgtgaggcgatcacatctcagagacaactaccaaacacacgtctgtttcagacaaatgaaacagtccngagacgccgaaggacacggctgtcgtactcgactgngtcagagactgaccggacgggtccgtttaccccg

SEQ ID NO: 321541 - DNA, 620 bp, Homo sapiens
  misc_feature: GZ8MTXP02JM1E6.4.25.C03.1.454.CMB.2.raw
  modified_base (214)..(214): a, c, t, g, unknown or other
  misc_feature (214)..(214): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccnccaggctccgaggcaaggggctgggagtgggtggctattagttggtatgatggaagtaagaaatactatgcagagtccgtgaaggccgattcaccatctccagagacaacttccaaacaacacgctgtttcctgacaaatgaactagcctgagacgccgagacgacggctgtgtatcacgtgtgtcagagagtacggccggtaggggtcccgttaccccgtcgttacgggtttcccttcggaaccttaggtttagtacgggttaagtcgggtaccggttcggtcgggggtaccgtaggggaccgttacgggtaccgacccggttcctccgttacgacggtcccttccgaacccgaacgggcccctacgttcccgggtccctttcccccgcggtaccctaacccccg

SEQ ID NO: 321542 - DNA, 671 bp, Homo sapiens
  misc_feature: GZ8MTXP02JMAJA.4.25.C03.1.454.CMB.2.raw
  modified_base (276)..(276): a, c, t, g, unknown or other
  misc_feature (276)..(276): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtcgtgggggagcgttgtccagcctgggaggtccctgagactctcctgtgcagcgtctgcattcaccttnaggagctagtgggatcgcacgtggggtcccgccagggcctccgagggcgaaggggctggggagtggggtgctagttagtttggatggatggaaagtaagaatactatgacaaggtagtccggtaggaacggggccgtaacgttaccaaccgtacttacctaccgaggaactaacctaaacttacccaaaacaaacctaccggtacttacggttttacctacgtaactaaaactacgaaaccaacggtacccgtaaggaacggaacgggaacccggaacgggtaaaccgacgggtacgttacgggtacggtaacttaccgtaacgttggttacgtaacgaaggaacggttaacggtcgggacccgggtaaccgggggttccccggtttacccccgg

SEQ ID NO: 321543 - DNA, 548 bp, Homo sapiens
  misc_feature: GZ8MTXP02HLBHW.4.25.C03.1.454.CMB.2.raw
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagcttgggttttcctcgttgcttcttttaagaggtgtccagtgtcacgtgcgcctggtggagtcgtgggggagcgttgtccagccgtgggagtccctgagactctcctgtgcagcgtctgcattccaccttcagganctagtgggatgcacgtggggtccncaggctccgaggcgaaggggctgggagtggggtgctattagttggatgatggaagtaagaatctagtgacagagtccgtagaaagggccgattcaccatctcagagaacaactaccaaacaacacgtcttgtttcagacaaananaacacgacgagagacgacgacgacgacgcgtcgtacgtactactacgtagtagtaacgacgacgacgtacgaccggtaccgggtaccggtacccg

SEQ ID NO: 321544 - DNA, 565 bp, Homo sapiens
  misc_feature: GZ8MTXP02FSD1Q.4.25.C03.1.454.CMB.2.raw
  modified_base (214)..(214): a, c, t, g, unknown or other
  misc_feature (214)..(214): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccnccaggctccaggcaaggggctggagtgggtggcacttattggtatgatggaagtaagaaatactatgcagagtccgtgaaggccgattcaccatctcagagacaattccaaacaacacgctgtttcctagacaaatgaacacgcctgagagccgagacacggctgtgtatcactgtgtcagagatcggccggagggtccggttacccctcgttcggttcccgttcgtactagttagtgtacgtgggacgtcgtggggaccgtaggggacgtacgggtcctaccgtcctacctcgacgcctacccgaccgaacggccctacgtccggtccgttcccccgcggacctaccccg

SEQ ID NO: 321545 - DNA, 610 bp, Homo sapiens
  misc_feature: GZ8MTXP02JUQQC.4.25.C03.1.454.CMB.2.raw
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccgaggcgaaggggctgggagtggggtggctacttagttggtatgatggaaagtaagaaatactatgcagagtccgtagaagggccgattcacatctaccagagacaattccaaacaacacgctgtttcctgacaaatgaacagcctgagagccggagacacggctgtgtatcacgtgtgtcagagagcggaccggacggggtacccgttacccctgttccgggtttcccgttcgacgttaggttagtgggtacgtacgggtacgtcggttacggggccgtacgggaccgttacggtctacccggtcctcccgtacgaccgtcccctacccgaccgaacgggcccctaacgttcccggttacccgttcccccgtcggcccctacccccg

SEQ ID NO: 321546 - DNA, 664 bp, Homo sapiens
  misc_feature: GZ8MTXP02FZ2N5.4.25.C03.1.454.CMB.2.raw
tcagagcactgtagcacgaccggtgctcgatttagtagtgtagatttgggtttgggctgagctgggttttcctcgttgctcttttaagaggtgtccagtgtcacgtgcgcctggtggagtctggggggaggcgttgtccagcctgggaggtccctgagactctcctgtgcagcgtctgcattcaccttcaggagctagtgggatgcacgtgggtccgccaggcctccgagggcgaagggggctgggaggtggggtggctactttagtttggtatggatagggaaagtaagaaatactatgacaggaggtccgtaggaacggggccgattccaccatcctaccgaagacgaacaaacttacccaaacaaaccacgtcttcgtttacctagacaaaatcgaaacacgcctggacgacgaccggagaccgacggctgtagtactcgtacgtgtgtacagacgagtcggaccggacgggtcccgtttacccctcgttcggttacccttcgactaggtttagtacggttagtcggggtacggttcggtacgggggtacctaagggggtaccttacgggtcctacccggttcctaccgtacgaccgtccctaccgaacccgaacgggtcccctacggttcccggtccctcccccgcggacccctaccccg

SEQ ID NO: 321547 - DNA, 620 bp, Homo sapiens
  misc_feature: GZ8MTXP02IPSYV.4.25.C03.1.454.CMB.2.raw
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtcgtgggggagcgttgtccagccgtgggaggtccctgagactctctgtgcagcgtcngcattcaccttcaggagctagtgggatgcacgtggggtcccnccgaggcctccgaggcgaaggggctgggaggtgggtgctacgtttagttggtatgagtagggtaaagtaagaattctaagtggactaaggtacgtcccggtaggaacgggtccgaacttccgaacctatcctaccgaagaacgtaacaaacttaccaaaacctaacgaaccggtcttacgttttacaggtaccaaaagtcgaaactacgacctaggacgacgaccgaaggaccgacgggtctggtacgtactaccgtacgttcgtagaacgagaacgtacgacggtacccggaacggggttcccgtttaccccg

SEQ ID NO: 321548 - DNA, 569 bp, Homo sapiens
  misc_feature: GZ8MTXP02H9962.4.25.C03.1.454.CMB.2.raw
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (413)..(413): a, c, t, g, unknown or other
  misc_feature (413)..(413): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtcgtgggggaggcgttgtccagcctgggagtccctgagctctcctgtgcagcgtctgcattcaccttcagganctatgggatgcacgtggggtccnccaggcctccgaggcaaggggctgggagtggggtgctacgtttagttggtatgagttggaaaagtaagaattactatgacaggcgtaccgtagaacgggccgatcgacancctacagagactaataccaacgaaacacgtctacgtttcagacaaatgaaacagaccgtagacgagaccgaaggacgacggtctagttcgtactaccgacttggtacgtaacgaacgagagtcggacccggtacggggtaccccggtttacccccg

SEQ ID NO: 321549 - DNA, 605 bp, Homo sapiens
  misc_feature: GZ8MTXP02HXEHT.4.25.C03.1.454.CMB.2.raw
  modified_base (352)..(352): a, c, t, g, unknown or other
  misc_feature (352)..(352): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgcaggcctccgaggcgaaggggctgggagtggggtgctacttattggtatgatggaaagtaaagaaatactatgcaggagtccgtgaagggccgattcaccatctccagagacaattccaaacaacacgcttgtttccngacaaatgaacagcctgagacgccgaggtacacggctgtgtatcactgtgtcagagatcggccggacggggtccggttacccctcgttcgggtttcccttcgaaccgttaggttagttagggtacgtcgggtacggtcggttcgggggacccgtaggggaccgttaccggtcctaccggtcctccgtccacgtccctaccgaacccgaacgggccctacgtcccggttccttcccccgtcggtaccctacccc

SEQ ID NO: 321550 - DNA, 719 bp, Homo sapiens
  misc_feature: GZ8MTXP02F2A8K.4.25.C03.1.454.CMB.2.raw
  modified_base (160)..(160): a, c, t, g, unknown or other
  misc_feature (160)..(160): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (338)..(338): a, c, t, g, unknown or other
  misc_feature (338)..(338): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagcgtggtttccncgttgctctttaagaggtgtccagtgtcacgtgcgctggtggagtcgtgggggagcgttgtccagcctgggagtccctgagactctcctgtgcagcgtctgcattcaccttnagganctagtggatgcacgtgggtcccaccgaggcctccgagggcgaaggggctgggaggtcgggnggtacctagtttagtttggtataggtaagttggggaaaacttaaaggtaattacgtaagtacggacctagggtaacggttacccgggtagggaaacgggggtaccctaacgttacccaaacccgtacttacccgtacccgaaagggtaaccgaaacccgtaaactttaaccccgaaaactaaaccgtaacccggtttacgtttacgtttacgtaacggtaacgtaaaacgtaacgaacgacgtacgtacggacggaacggaccggaacggaaccggacggtacggttacggttacgttacgtaccgtacgttacgttacgtaacgaacggtaacggtacggtaccgggtaccgggtacccggggttacccggtttacccgg

SEQ ID NO: 321551 - DNA, 536 bp, Homo sapiens
  misc_feature: GZ8MTXP02JKI9O.4.25.C03.1.454.CMB.2.raw
  modified_base (343)..(343): a, c, t, g, unknown or other
  misc_feature (343)..(343): n is a, c, g, or t
  modified_base (415)..(415): a, c, t, g, unknown or other
  misc_feature (415)..(415): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctgggagtgggtggcacttattggtatgatggaataagaaatactatgcagagtccgtgaagggccattcaccatctccagagacaattccaaacaacacgctgtttccngacaaatgaacagcctgagagccgaggacacggctgtgtatcactgtgtcagagatgcgaggcgttaccctntggttcctgactagttagtgtanggacgtcgnggggtcctagggactacggtcaccgtctcctcacgtccctccgacgaacgggcccacgtccggtaccttcccccgtcggacctaccccg

SEQ ID NO: 321552 - DNA, 623 bp, Homo sapiens
  misc_feature: GZ8MTXP02GJ7OP.4.25.C03.1.454.CMB.2.raw
  modified_base (214)..(214): a, c, t, g, unknown or other
  misc_feature (214)..(214): n is a, c, g, or t
tcagagcactgtagcacgaccggtgctcgatttagtagtgtagatttgggtttgggctgagctgggttttcctcgttgctcttttaagaggtgtccagtgtcaagtgcgcctggtggagtctgggggaggcgttgtccagcctgggaggtccctgagactctcctgtgcagcgtctgcattcaccttcaggagctatgggatgcactgggtccnccaggctccgaggcaaggggctggagtgggtggctacttattggtatgatggaaagtaagaaatactatgcagagtccgtagaagggccgattcaccatctccagagacaattccaaacaaacacgcttgtttcccagacaaaatgaaacagcctggagacgccggaggaccacgggtctgtgtatcacgtgtgtacagagagtcggaccgggacggggtcccggttaccccttcgttacggtttcccgttacgacgtacgtttagtcgggttatcggggtacgttcggtcgggggtaccgtaggggacctaacggtccgtaccggtcctaccgtcgaccgtccctaccgaaccgtaaccgggccctaacgttcccggtcccgttcccccgtcggacccctaacccccg

SEQ ID NO: 321553 - DNA, 620 bp, Homo sapiens
  misc_feature: GZ8MTXP02IEX31.4.25.C03.1.454.CMB.2.raw
  modified_base (277)..(277): a, c, t, g, unknown or other
  misc_feature (277)..(277): n is a, c, g, or t
  modified_base (301)..(301): a, c, t, g, unknown or other
  misc_feature (301)..(301): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgctggtggagtcgtgggggagcgttgtccagcctgggagtccctgagctctcctgtgcagcgtctgcattcacttcagganctagtgggatgcacgtgggtcccncaggctccgagggcaaggggctgggaggtggggtgctacgtttgtttgggtatggagtagggtaaaagtaaacgtaaatcttaagtacggacctaagggacggttaccgggtaggaaaccgggggtcctaagttaccaaccgtaactcctacccgaagaacgaactaacttaccaaaccgaaactacgtacttacgtttcacgtacaaagtacgaaacagaccgtagacgacgaccggacggaacgacggcgttgtacgtaactcacgttgtacgtaacgagaagtacgtcggaccggtacggggtacccgtttacccg

SEQ ID NO: 321554 - DNA, 675 bp, Homo sapiens
  misc_feature: GZ8MTXP02HYURB.4.25.C03.1.454.CMB.2.raw
  modified_base (262)..(262): a, c, t, g, unknown or other
  misc_feature (262)..(262): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgcttcttttaagaggtgtccagtgtcacgtgcgcctggtggagtcgtgggggagcgttgtccagcctgggagtccctgagctctcctgtgcagcgtntgcattcaccttcagganctagngggatgcacgtgggtcccnccgaggcctccgaggcgaaggggctagggaggtgggtggctacgtttagtttggggtatggaagttagggaaaagttaagaaacgttactaagtcggacctaaagggtacggttacccgggtagggaaacggggtacccgtaagtttcccgaacccgtagtcccttaccggaacggtaaacgtaaccctaaactttaccccgaaaactaaaccgtaccgtacgtttacggttttacgagtaaccgtaaaagtacgaaacctacggtacccgtagaacggacgacccggaaggaccgacggtcctaggtacgtaactcgtacgttgtacgtgacgtagacgtacggaccggtacggggtcccgtttaccccg

SEQ ID NO: 321555 - DNA, 650 bp, Homo sapiens
  misc_feature: GZ8MTXP02FMU7C.4.25.C03.1.454.CMB.2.raw
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctgggagtgggtgcattatttggatgatggaagtaagaaatactatgcagagtccgtagaagggccgattcaccatctccagagacaattccaaacaacacgtctgtttcctagacaaatgaacagcctggagagaccgagacacggctgtagtatcacgtgtgtacgagagagtcggaccggacggggtcccgttaacccccgttcgttcgggtttcccgttcgtaacgttaaggtttagttcggggttaagttcggggtaccggttcggtcgggggtacccgttaacgggggaccttaaccggggtcccaaccggttcccttaccgtaccacgtacccctacccgaaacccgaaccggggtcccctaacggtttcccggttcccgtttccccccgtacgggccccttaacccccg

SEQ ID NO: 321556 - DNA, 530 bp, Homo sapiens
  misc_feature: GZ8MTXP02GAUUR.4.25.C03.1.454.CMB.2.raw
  modified_base (281)..(281): a, c, t, g, unknown or other
  misc_feature (281)..(281): n is a, c, g, or t
  modified_base (434)..(434): a, c, t, g, unknown or other
  misc_feature (434)..(434): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcagganctagtgggatgcacgtggggtcccgccaggcctccgagggcaaggggctgggagtggggtgctattatttggatgatggaataagatcatgacagagtccgtgaaggccgattcacatcacagagacaattaccaaacaacacgctgttactnacgaaatgaacacgactgagagaccgaggacgacggctggtatatactacgtgtgtaacgagagacgtacggccggtacgggtccggtttaccccg

SEQ ID NO: 321557 - DNA, 883 bp, Homo sapiens
  misc_feature: GZ8MTXP02JHMA3.4.25.C03.1.454.CMB.2.raw
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctagtgggatgcacgtcgggtccgccaggcctccgaggcgaaggggctgggaggtgggtgctacgtttagttggtatgagtaggaaagtaaagaaatactatgacaggagtccggtaggaaacgggccgtaacttccaaccgtatccctaccgaagaacgaaacctaaacgtttacccaaaaccaaaccgtaaccgtctttacggttttacccagtaacctaaaaacttacggaaaacctacggtaccctagggaaacggaacgggacccgggaaagggaccgtaaaccgggtccgttagggttaacgttaaacgtcccgttaaacgtaggtttacggaaccgtaaaggaacggtacgttcccggggaacccggggtaccgggggttacccccgttttaacccccggttcggtttaaccgggtttcccccgttaacggtaaccgtttaacggggtttaacgttagggggttaacgttaccgggggtaaccgtttccggggtacgggggtaaaccccgggttaacggggtaacccggtttaacccgggttccgttaaaccccggttcccgtaacccgttccggtaacccgtacccccgttacccgaaaaccccgggtaacgggtaccccctaacgggtttccccggttacccccgtttacccccccggtcggtacccccttaaccccccgg

SEQ ID NO: 321558 - DNA, 734 bp, Homo sapiens
  misc_feature: GZ8MTXP02J05I7.4.25.C03.1.454.CMB.2.raw
  modified_base (282)..(282): a, c, t, g, unknown or other
  misc_feature (282)..(282): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgcttcttttaagaggtgtccagtgtcacgtgcgcctggtggagtcgtgggggagcgttgccagccgtgggacgtccctgagactctctgtgcagcgtctgcattcaccttcgagganctagtgggatgcacgtcgggtcccgccgaggcctccgagggcgaaacgggggctaggggaggtggggtcggctaacgtttagtttggtatggaagttagggaaaagttaaagaattactagtagacgaagtacggtaccggtaggaaacggggtccgtaatttacccaacctactcccgtacccgaaggaaacgtaaacctaaaacgttaccccaaaacctaaacccgtaccggttacctttacggtttaccttaacggaaacctaaaaagttacgaaaaccgtaacggtacccgtaagggaaccggaaccgggaacccggaacggggaaaccgaccggggtaccttgggttaacggtaaacgtcctaaaccgttcggtaggtaaccgtaacggtacggacggttaccgggaccccggggtaacgggggtacccccggtttttaacccccgg

SEQ ID NO: 321559 - DNA, 630 bp, Homo sapiens
  misc_feature: GZ8MTXP02IHAXE.4.25.C03.1.454.CMB.2.raw
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgcttcttttaagaggtgtccagtgtcacgtgcgcctggtggagtcgtgggggagcgttgccagccgtgggagtccctgacgctctcctgtgcagcgtctgctatccacttcaggagctagngggatgcacgtgggtcccncaggcctcgaggcgaaggggcngggaggtgggngctacgtttagtttggtatgaacggtaggtaaagtaaagtaagtactagtcggacaagggtacgtcccggtagggaacgggtccgaagtttacccacctacttacccgtaccaaggaactaaccaaacttaaccaaaccaaaccgtaccgtctttacgtttactacgtaactaaacgtacgaaacacgtaccgtaggaagacggacgaacggtaacacggtacgtacgttagtacgtctacgttgtagtaacgagaacgtcgtacggaccggtaacggttcccgtttacccg

SEQ ID NO: 321560 - DNA, 562 bp, Homo sapiens
  misc_feature: GZ8MTXP02HCIID.4.25.C03.1.454.CMB.2.raw
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
  modified_base (451)..(451): a, c, t, g, unknown or other
  misc_feature (451)..(451): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctggggggaggcgttgtccagcctgggaggtccctgagactctcctgtgcagcgtctgcattcaccttcaggagctatgggatgcacgtgggtccgccaggcctccgaggcaagggggctgggagtgggtgctattagttggtatgatggaaagtaagaaatactatgcagagtcgagaagggccattcacatcncaganacaatccaacacacgctgttcctgacaaatgaacagctgagagccgagacacggctgtntagtccatcgtnacgagacgatcggacggacggtccggttacccttcgtcggttcccttagactaggtttanggtagtcgggacgtcggtacggggaccgtagggaccttaacggtcaccggttctccgtcacgcctaccgaccgaacggcctacgtcccggtcctccccgtcgccctacccg

SEQ ID NO: 321561 - DNA, 632 bp, Homo sapiens
  misc_feature: GZ8MTXP02GU17V.4.25.C03.1.454.CMB.2.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtcgtgggggaggcgttgtccagcctgggaggtccctgagactctcctgtgcagcgtctgcattcaccttcagganctagtgggatgcacgtgggtccnccaggctccgaggcgaaggggctgggagtggggtgctatttagttggatggataggaaagtaagaaatacatgacagagtccgtaggaagggccattcacatctaccagagacaaattaccaaacaacacgcttgttcctagacaaaatcgaaacagcctgacgacgaccggaaggaacctacgggcttggtagtatcctagtgtgtacgaagagagtcggcgacggggtcccgttaccctgttcggttcccttagacttaggttacgtggtagtcgggtacgtcggtcggggacccgttaggggaccttaacggggtccaaccggttcctccctacgtaccgaccctaccgaacccggtaaaccgggccctaaccggtcccggtccctttacccccgcggtacccctaaccccc

SEQ ID NO: 321562 - DNA, 543 bp, Homo sapiens
  misc_feature: GZ8MTXP02FH0WW.4.25.C03.1.454.CMB.2.raw
  modified_base (350)..(350): a, c, t, g, unknown or other
  misc_feature (350)..(350): n is a, c, g, or t
  modified_base (471)..(471): a, c, t, g, unknown or other
  misc_feature (471)..(471): n is a, c, g, or t
  modified_base (497)..(497): a, c, t, g, unknown or other
  misc_feature (497)..(497): n is a, c, g, or t
  modified_base (534)..(534): a, c, t, g, unknown or other
  misc_feature (534)..(534): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctggggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaaagtaaagaaatactatgcagagtccgtgaagggccgattcaccatctccagagacaaattccaaacacacgcttgtttcccngacaaaatgaaacagcctgagagccgaggacacggctgtgtatcactgtgtcagagagtgccggaggggccgtttaacccctgttcggttccctcgactaggttatggtatggacgttcgnggggctagggactacggtcaccgtcncacgacgccaccaccgaagccctatccggtcctcccngccctaccc

SEQ ID NO: 321563 - DNA, 530 bp, Homo sapiens
  misc_feature: GZ8MTXP02GWI70.4.25.C03.1.454.CMB.2.raw
  modified_base (307)..(307): a, c, t, g, unknown or other
  misc_feature (307)..(307): n is a, c, g, or t
  modified_base (387)..(387): a, c, t, g, unknown or other
  misc_feature (387)..(387): n is a, c, g, or t
  modified_base (455)..(455): a, c, t, g, unknown or other
  misc_feature (455)..(455): n is a, c, g, or t
  modified_base (478)..(478): a, c, t, g, unknown or other
  misc_feature (478)..(478): n is a, c, g, or t
  modified_base (495)..(495): a, c, t, g, unknown or other
  misc_feature (495)..(495): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcgccatggagtttgggctgagctgggttttcctcgttgctcttttaagaggtgtccagtgtcacgtgcgcctggtggagtcgtgggggaggcgttgtccaggcctggggaggtccctgagactctcctgtgcagcgtctgcattcaccttcaggagctagtgggatgcactggggtccnccaggctccaggcaaggggctggaggtggggtgctacttagtttggatgagtggaaataagaatctatgacagagtccgngaagggcgattcacatctacagagacaacttccaaacaacacgtacttgttactgacaaagtgaaacngcagagacgacgaggacgcggtntgtgtacgtcacgttgngcgagagactcggaccggacgggtccggtttaccc

SEQ ID NO: 321564 - DNA, 563 bp, Homo sapiens
  misc_feature: GZ8MTXP02JRQBI.4.25.C03.1.454.CMB.2.raw
  modified_base (218)..(218): a, c, t, g, unknown or other
  misc_feature (218)..(218): n is a, c, g, or t
  modified_base (348)..(348): a, c, t, g, unknown or other
  misc_feature (348)..(348): n is a, c, g, or t
tcagagcactgtagcacgaccggtgctcgatttagtagtgtagatttgggtttgggctgagctgggttttcttcgttgctcttttaagaggtgtccagtgtcacgtgcgcctggtggagtctggggggaggcgttgtccagcctgggaggtccctgagactctcctgtgcagcgtctgcattcaccttcaggagctatgggatgcacgtggggtcccnccaggctccgaggcgaaggggctgggagtgggtgctacttattggtatgatggaagtaagaaatactatgcagagtccgtagaagggccattcacatctcagagacaattccaacaacacgcttgttccngacaaatgaacagctgagagccgagacacggctgtgtatcactgtgtacagagagtcgaccggagggccgttaccccgtgttcgggttcctcgactagttacgtggtagtggacgttcggtgggaccgtagggacctacggtcaccgtcgtacctcgacgtccctaccgaccgaacgggccctacgtccggtccctccccgtcgaccctaccccg

SEQ ID NO: 321565 - DNA, 709 bp, Homo sapiens
  misc_feature: GZ8MTXP02ILGQQ.4.25.C03.1.454.CMB.2.raw
  modified_base (182)..(182): a, c, t, g, unknown or other
  misc_feature (182)..(182): n is a, c, g, or t
  modified_base (244)..(244): a, c, t, g, unknown or other
  misc_feature (244)..(244): n is a, c, g, or t
  modified_base (311)..(311): a, c, t, g, unknown or other
  misc_feature (311)..(311): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgcttcttttaagaggtntccagtgtcacgtgcgcctgggtggagtcgtgggggagcgttgccagcctggggacgtcccngagctctcctgtgcagcgtctgcattccaccttcgaggagctagtgggatcgctacgtggggtcccnccgaggcctaccgagggaccgaagggggctaggggaggtcggggtgacctagtttagtttgggtataggaagttacgggaaaagttaaagtaattaccgtagtacggactaaggggtaacggttcccgggtaaggaaacgggggtccctaagtttacccaaccgtaactaccctaccgaaacggtaacgtaaaccctaaaacttaccccgaaaacctaaaaccgtaccggtactttacgttttaccgacggtaacaaaacgttacggaaaacctacggaccgtaggaacggaacgtacccgggacggtaaccgacgggtcgtacggtcgttaaactcgtacgtgttacgaacgaaggacgtacggtcggcccgggttaacggggtccccgtttacccg

SEQ ID NO: 321566 - DNA, 672 bp, Homo sapiens
  misc_feature: GZ8MTXP02ITKLH.4.25.C03.1.454.CMB.2.raw
  modified_base (280)..(280): a, c, t, g, unknown or other
  misc_feature (280)..(280): n is a, c, g, or t
  modified_base (302)..(302): a, c, t, g, unknown or other
  misc_feature (302)..(302): n is a, c, g, or t
  modified_base (384)..(384): a, c, t, g, unknown or other
  misc_feature (384)..(384): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtcgtgggggagcgttgtccagcctgggaggtccctgagactctctgtgcagcgtctgcattcaccttcagganctagtggatgcacgtgggtccncaggctccgaggcaaggggctagggacggtgggtggctacgtttacgttggtatggagtaggaaaattaagaattactaagngacgaggtacggtccggtaggaacgggtaccattccgaacctatcctacgaagaacgaacctaaacttacccaaaacaaaccgtaacgtccgttaacgttttcgtaaacggtaacctaaaacgttacgaaaaccgtaacgaacccgttgggaaaaccggaacggaccccggggaaacggtaaaacccgtacccgggggatttaccggttaattaaccgtccgtaagttacgtacgttaacgaaggtacgaacgttcggaccggtacgggggtaccccttttaccccgg

SEQ ID NO: 321567 - DNA, 732 bp, Homo sapiens
  misc_feature: GZ8MTXP02HQ9VG.4.25.C03.1.454.CMB.2.raw
  modified_base (215)..(215): a, c, t, g, unknown or other
  misc_feature (215)..(215): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcacgtgggtccncaggctccgaggcgaagggggctgggagtgggtggctacgttatttggtatgagtggaaagtaaagaaatactatagcagagtcgtaggaagggccgattcaccatctaccaagacgaacaaacttaccaaaacaaacacgtcttcgtttacctagtaacaaagtagaaacacgacctggaacgaacggccggaacggacgaacgggcttaggtcgttaaatcccgtattggtacgtacgaagagtacgtacggacccggggtacgggggttaccccggtttaacccccgtttcggttccgggtttttcccgtttacggaacgttaacggtttaaggttaggggttaacgttggggtaacccggttcgggttacgggggtaccgtttaacggggaccctttaacggggtccctacccgggttcctacccgttcgaccgtaccccgacccgaacccggaaaccgggccccgttacgttccccggtccccgtttcccccgcgggtacccctaacccccg

SEQ ID NO: 321568 - DNA, 728 bp, Homo sapiens
  misc_feature: GZ8MTXP02IRGGO.4.25.C03.1.454.CMB.2.raw
  modified_base (221)..(221): a, c, t, g, unknown or other
  misc_feature (221)..(221): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtcgtgggggaggcgttgtccagccgtgggaggtccctgagactctcctgtgcagcgtctgcattccaccttcgaggagctagtgggatgcacgtcgggtccncaggctccgaggcgaaggggctgggagtgggtgctacgtttagttggtatgagtggaaagtaagaaatacagtgacagagtccgtaggaacggcctattccactatcctaccaagaacgaactaacttacccaaacaaaccgacgtctttagtttccccagacctaaaagtacgaaacacgtcctaggaacggacggaccggaacgggaccgtaacgggtcttaggtacgttactacgtacgttggtacgtacgaaggtagtaacgtccgggaacccgggtacgggggttaccccgtttaacccccgttcggtttaccgggtttaccccgtttacggaaccgtttaagggtttagtagggttaacgttcggggaccggttcggtacgggggtacctaacgggggtaccttaaccgggtcctacccgtcgtcctacgccgtaccctaccgaaccggaaccgggtcccctacggttccccgtccccttccccggcgtaccccctacccg

SEQ ID NO: 321569 - DNA, 563 bp, Homo sapiens
  misc_feature: GZ8MTXP02FH9DU.4.25.C03.1.454.CMB.2.raw
  modified_base (282)..(282): a, c, t, g, unknown or other
  misc_feature (282)..(282): n is a, c, g, or t
  modified_base (305)..(305): a, c, t, g, unknown or other
  misc_feature (305)..(305): n is a, c, g, or t
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtctgggggaggcgttgtccagcctggggaggtccctgagactctcctgtgcagcgtctgcattcaccttcagganctagtgggatgcactggggtccnccaggctccgaggcgaaggggctggggagtggggaggctactttagttggtatggatagggaaagtaagaatactatgacagagtcgtaggaacggcgtatcacatcncagagaactataccaanaacacgtctgttctagactaaatcgaaacacgctaggagacgaccgaggaacacgggctggtacgtactccgtaacgtggtagaaccgagaaggacgttcggacccggtacgggggtcccggtttaacccccg

SEQ ID NO: 321570 - DNA, 570 bp, Homo sapiens
  misc_feature: GZ8MTXP02FTQHG.4.25.C03.1.454.CMB.2.raw
  modified_base (278)..(278): a, c, t, g, unknown or other
  misc_feature (278)..(278): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtcgtgggggaggcgttgtccagcctgggaggtccctgagactctcctgtgcagcgtctgcattccaccttnaggagctagtgggatgcactcggggtcccgccaggcctccgaggcgaaggggctgggaggtggggtgactactttagtttggtatggattaggaaagtaaagaatactaatgacgagtacgtccgtagaacgggcattccacactcacagacaacaacttaccaacaaaccgacgtcttagttctagaactaaatagaacacgctaggacgacgaccgaggacacgggctgtacgtatccgagtgtcgtaacgaggagtacgcggacccggtacgggtcccgtttaaccccg

SEQ ID NO: 321571 - DNA, 554 bp, Homo sapiens
  misc_feature: GZ8MTXP02IVPSX.4.25.C03.1.454.CMB.2.raw
  modified_base (214)..(214): a, c, t, g, unknown or other
  misc_feature (214)..(214): n is a, c, g, or t
  modified_base (388)..(388): a, c, t, g, unknown or other
  misc_feature (388)..(388): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccnccaggctccaggcaaggggctggagtgggtggcacttattggtatgatggaagtaagaaatactatgcagagtccgtgaagggccattcacatctccagagacaattccaaacaacacgctgttcagacaaatgaacagcctggagagccgagacacggctgtgtatcactgtntcagacgatgcgagggcgttaccctgttcggttccttcgactagttactggtagtggtacgtcgtggggtacctagggaccttacggtctaccggtctaccgtcacggccctaccaccgtaacgggccccaacgttccggtaccttcccccgtggaccctaccccc

SEQ ID NO: 321572 - DNA, 672 bp, Homo sapiens
  misc_feature: GZ8MTXP02ICDUH.4.25.C03.1.454.CMB.2.raw
  modified_base (289)..(289): a, c, t, g, unknown or other
  misc_feature (289)..(289): n is a, c, g, or t
  modified_base (315)..(315): a, c, t, g, unknown or other
  misc_feature (315)..(315): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagcttgggttttcctcgttgcttcttttaagaggtgtccagtgtcacgtgcgctgggtggagtcgtgggggaggcgttgtccagccgtgggacggtccctgagcttctctgtgcagtcgtctgctattccaccttcgagganctagtgggatgcacgtcggggtcccncgacggcctccgagggcgaaggggctgggaggtggggtgctatttagttggtatgagtaggaaaagtaaagtaattacgtatgacgtaggtacggtacgtagggaaccggggtccgtaattaccaaccgtactccgtacgaagtaacaaacctaaaccttacccaaaacctaaaccgtaccgttaccgttaggtttttaccacggtaacctaaaagtacgaaaaccgtacggacccgtaggaacggaaccgggaccggaacggaaccgaccgggtcgttacggtagtactaccgtacgttggtacgtcgaagagtacgtaccggggaccgggtaaccgggttccccggtttaccccg

SEQ ID NO: 321573 - DNA, 548 bp, Homo sapiens
  misc_feature: GZ8MTXP02GP2BK.4.25.C03.1.454.CMB.2.raw
  modified_base (396)..(396): a, c, t, g, unknown or other
  misc_feature (396)..(396): n is a, c, g, or t
  modified_base (480)..(480): a, c, t, g, unknown or other
  misc_feature (480)..(480): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtcgtgggggagcgttgtccagcctgggagtccctgagctctcctgtgcagcgtctgcattcaccttcaggagctagtgggatgcacgtggggtcccgccgaggcctccgaggcaaggggctgggagtgggtgctacttagtttggatgatggaaataagatactatgcagagtccgtgaaggcatcacntctaccagagaacaataccaaacaaacacgcttagtttctgaacaaatacgaacgacgcctagagacgaccgaaggacgacggntacgtgtactcgactcgtagtaacgagtaacgacgtacggaccggtaacgggtcccggtttaaccccg

SEQ ID NO: 321574 - DNA, 682 bp, Homo sapiens
  misc_feature: GZ8MTXP02FF6U5.4.25.C03.1.454.CMB.2.raw
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (315)..(315): a, c, t, g, unknown or other
  misc_feature (315)..(315): n is a, c, g, or t
tcagagcactgtagcacgaccggtgctcgatttagtagtgtagatttgggtttggggctgggagaggagcccagcactagaagtcggcggtgtttccattcggtgatcagcactgaacacagaggactcaccatggagtttgggctgagcttgggttttcctcgttgcttcttttaagaggtgtccagtgtcacgtgcgcctggtggagtcgtggggggagcgttgtcccaggcctggggacggtcccctgagacctctcctgtgcagcgtctgcattcaccttnagganctagtgggatgcacgtcggggcccnccgaggcctaccgagggcgaagggggcctaggggtaggtggggtgctacgtttagtttgggatagacgttagggaagtaaaacgtaatactaagtcgacgtagacggtccggagaacggggcctagttaccacctagtccctaccgaagaacgtaacctaacttaacccaaaccgaaacaccggtcctttaggtttaccctagaaacctaaaagttacgaaaccgtacggtaccccgtagaaacgggaccggaccgggtaaacgggaaccgaaaccgggggtcttaggtacgtaaacgtcgtaccgtaggttacgaacgaacggacgtagtccggaccggggtaaccggggtcccggtttacccccg

SEQ ID NO: 321575 - DNA, 644 bp, Homo sapiens
  misc_feature: GZ8MTXP02I2PW4.4.25.C03.1.454.CMB.2.raw
  modified_base (197)..(197): a, c, t, g, unknown or other
  misc_feature (197)..(197): n is a, c, g, or t
  modified_base (215)..(215): a, c, t, g, unknown or other
  misc_feature (215)..(215): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctangggatgcacgtgggtccnccaggcctccgaggcaaggggctgggagtgggtgctactttagttggatgatggaagtaagaaatactatgacagagtccgtagaggccgattcaccatcctacagagactaacttccaaacaacacgctcgtttctgacaaatcgaacacgcctaggacgacggaccggaggaaccacgggtcttagtagtactctacgttcggtagtacgagagacgtcggacccgggtacggggtcccggttaccccgtcgttcggttcccgttacgaccgtaggttagtacggttagtcggtaccggtcggtcggggtacgtacggggaccttaccgggtaccgtaccgtcctccgttacgaccgaccctaccgaaacccgaaccgggtacccctacggttcccggttccctcccccgtacggaccctacccccg

SEQ ID NO: 321576 - DNA, 792 bp, Homo sapiens
  misc_feature: GZ8MTXP02JTUUH.4.25.C03.1.454.CMB.2.raw
  modified_base (222)..(222): a, c, t, g, unknown or other
  misc_feature (222)..(222): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtcgtgggggagcgttgtccagccgtgggaggtccctgagacctctcctgtgcagcgtctgcattccaccttcgaggagctagtgggatgcacgtcgggtcccncaggcctccgaggcgaaggggctgggaggtgggtgctagttagttggtatgataggaaagtaagaaatactagtgacgaggacggtccggtaggaacgggtccgtacttaccgaacctacgtacctaccgaagaacgaacctaaacttaccaaaacaaccgtaccgtctttaggtttacccagaacctaaagtacgaaacgtacgacgtacggaacgacggacccggaaacgggaccgacggggttttctaggttacgttaacctacccgacgttggtacgtaccgaaggaagtcggtaccggggacccgggttaccggggttcccccgtttaaccccgtcgtttaaccgggtttcccccgtaagggtaactttagggtttaaggtcgggttacggtaccgggttacggttaccgggcgggggttacccgtaacgggggtacctacccgggttctaccccggttcccgttacctaccgggaccttacccccggtacccgaaaccgggtaaccgggtccccctaagggttacccccggttccccttaccccggcggtaccccctacccccg

SEQ ID NO: 321577 - DNA, 678 bp, Homo sapiens
  misc_feature: GZ8MTXP02HBEAB.4.25.C03.1.454.CMB.2.raw
  modified_base (215)..(215): a, c, t, g, unknown or other
  misc_feature (215)..(215): n is a, c, g, or t
  modified_base (286)..(286): a, c, t, g, unknown or other
  misc_feature (286)..(286): n is a, c, g, or t
  modified_base (383)..(383): a, c, t, g, unknown or other
  misc_feature (383)..(383): n is a, c, g, or t
tcagagcactgtagcacgaccggtgctcgatttagtagtgtagatttgggtttgggctgagctgggttttcctcgttgctcttttaagaggtgtccagtgtcacgtgcgcctggtggagtctggggggagcgttgtccagcctgggaggtccctgagactctcctgtgcagcgtctgcattcaccttgaggagctatgggatgcacgtgggtccncaggcctccgaggcgaaggggctgggagtgggtgctacttagttggtatgataggaagtaagaaatactangacagacgtccgtaggaaggccgattccaactactacgacaagacactaacttaccaaacaaccagtctttacgtttaccgagaccaaatcgaaacncgactaggacgagacccggaaaggacccagggtccttaggtatactaccgtaactggttagtaccgagagtaagttcgaccgggtaacgggtccccgtttaaacccgttgttaccggtttccttaacggagtaggttaagtagtagtagggtaacgttcggtaggggtacccgtaaggtaccggtaccgttaccggccgttctcccgttaaaccgaccgtacccgaacccgaacccggaaccggtaccctaccggttcccgtaccccgttcccccggtacgtacccccgtacccg

SEQ ID NO: 321578 - DNA, 590 bp, Homo sapiens
  misc_feature: GZ8MTXP01CECIZ.52.31.C09.1.454.CMB.2.raw
  modified_base (244)..(244): a, c, t, g, unknown or other
  misc_feature (244)..(244): n is a, c, g, or t
  modified_base (383)..(383): a, c, t, g, unknown or other
  misc_feature (383)..(383): n is a, c, g, or t
tcagcgcagtacgacacgaccggtgctcgatttagacgtctcatcaaggaaggaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagatgcattgaccaaaaaatntgcttatggtaccagcagaggtcaggccaggccctatattgatcatctatgaagacagacaaacgacccgctagggactccctcagacgattctcgtggcctacccagcctcaaggggacaagtggcccacttgactancacgtcggggcccgagggtagggaggagtggaaacgcgtcgcctttcttagtttcggttttttacaaactacggtacagacgtagttaggtaatcgagttagggtggttcggggacgggttagggggaccacgggtacgtcggttacccggttcgttacgggtccacggcccgaacggccgttccgtcccccgttcgggttaacccg

SEQ ID NO: 321579 - DNA, 583 bp, Homo sapiens
  misc_feature: GZ8MTXP01C2AT7.52.31.C09.1.454.CMB.2.raw
  modified_base (241)..(241): a, c, t, g, unknown or other
  misc_feature (241)..(241): n is a, c, g, or t
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
tcagcgcagtacgacacgaccggtgctcgatttagacgtctcatcaaggaaggaagggggtgggctcaggaggcagagctctgggaatctcaccatggcctggacccctctcctgctcccctcctcactttctgcacagtctctgaggcctcctatgagctgacacagccaccctcggtgtcagtgtccccaggacaaacggccaggatcacctgctctggagatgcattgacaaaaaatntnattatgacagcagagnacgcacgcctatatgatcatctanagaanacagacaaacgccgngtaggactccanagacgtattctcgtcgcctaccagctacgaacgggaactaacgtcggaccctacttacgactacgtacgacggtcgggaccgagggtagggaaggagtaggaacgtcgtcgtacctttacgttacgttttacgttttaacaaacgtacgaacgtagacgtaggtaggtaactacgtagtagggtcggtcgggacgggacggacgacggtcgtacgttaccgttcgttacggtcgacgcccgacggtccgttccgtccccgttccgtcc

SEQ ID NO: 321580 - DNA, 569 bp, Homo sapiens
  misc_feature: GZ8MTXP01BZMJK.52.31.C09.1.454.CMB.2.raw
  modified_base (243)..(243): a, c, t, g, unknown or other
  misc_feature (243)..(243): n is a, c, g, or t
tcagcgcagtacgacacgaccggtgctcgatttagacgtctcatcaaggaaggaaggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaggtcaggccaggcccctatattgatcatctatgaagacagacaaacgacccgctagggactccctcagacgattctctggcctaccagcgtcgaggggacaaagtcgggacccacttgactatccacgtgggcccgaggtcggaggatgaagctgcttcttagtttgtttttacaacagacagcgagtaggtaatcgagtagggttgttcgggcgggttaggggcccgagggtcgtcggaacccggttccgttaacgggtcacggccccgtaagggccgttaccggtcccccgttcgggttccccg

SEQ ID NO: 321581 - DNA, 547 bp, Homo sapiens
  misc_feature: GZ8MTXP01DACNL.52.31.C09.1.454.CMB.2.raw
  modified_base (240)..(240): a, c, t, g, unknown or other
  misc_feature (240)..(240): n is a, c, g, or t
  modified_base (313)..(313): a, c, t, g, unknown or other
  misc_feature (313)..(313): n is a, c, g, or t
  modified_base (425)..(425): a, c, t, g, unknown or other
  misc_feature (425)..(425): n is a, c, g, or t
  modified_base (482)..(482): a, c, t, g, unknown or other
  misc_feature (482)..(482): n is a, c, g, or t
tcagcgcagtacgacacgaccggtgctcgatttagacgtctcatcaaggaaggaaggggtgggctcaggaggcagagctctgggaatctcaccatggcctggacccctctcctgctcccctcctcactttctgcacagtctctgaggcctcctatgagctgacacagccaccctggtgtcagtgtccccaggacaaacggccaggatcacctgctctggagatgcattgaccaaaaaatntgcttattggtaccagcagaggtcaggccaaggcccctatattgatcatctatgaagacagcaaacgacccgntgggatccctcagagattctctggctcccagctcagggacaatcggcacttgactatcacgtgggccaggtggaggatgaagctgcctttctatttacgtttttacaaaccnggtacagcagttaggtaattgagttagggggtgtttcgggcgggaggggaacccggnggtacgtcggttaccggttccgttacgggtcgacgcccgacggccgttccgtccccgttcggtcc

SEQ ID NO: 321582 - DNA, 780 bp, Homo sapiens
  misc_feature: GZ8MTXP01A33KC.52.31.C09.1.454.CMB.2.raw
  modified_base (248)..(248): a, c, t, g, unknown or other
  misc_feature (248)..(248): n is a, c, g, or t
tcagcgcagtacgacacgaccggtgctcgatttagacgtctcatcaaggaaggaagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattagaaccaaaaaaatntgtacttatggtaccagcagaggtcaggccaggccctatactgatcatctatgaagacaacaaaccgacccgcgtagggactccctacgacgagtacttctcgtggcctccgaaagcctcgaacgggggactaaacgttcgggaccctaacttggaaaccttacttaccgaaccggttccggggggaccccgtaagggggttacggggaacgggtaacgttagggaaacgggtccttacgggtcccgttttactttaacgtttttacgggggttttttaacccaaacgttaacggaacccgtaaaggtacccgtaaagggttacgggttaaaacgttacggtaaaggtttaaagggggttcggtttaccggggggtaaccgggggtaaacgggggttaccccggaaagggggttccgtaacgggggtaaccccggttacccggtttacgggttcccggtaaacccgggtacccggaaaccgggtcccgtttccccgggacccccccgttcggggttcccctttaaccccggg

SEQ ID NO: 321583 - DNA, 707 bp, Homo sapiens
  misc_feature: GZ8MTXP01EAU0E.52.31.C09.1.454.CMB.2.raw
  modified_base (250)..(250): a, c, t, g, unknown or other
  misc_feature (250)..(250): n is a, c, g, or t
tcagcgcagtacgacacgaccggtgctcgatttagacgtctcatcaaggaaggaagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgcattacgaaccaaaaaaaatntgtacttagttcggtaaccagacagaggtcgacggccaggcccctatacttgatcatactatagaaagacagacaaaccgcccgacgtagggtactcccgtacagtacgtactttctccgtggtcctacccgaacgtccgtacgaacggggaacctaagtccgggaccctacgttacgaccttacgtaccgtacgggtcgggggacccgaaggggttagggaagggtaagtacgggaacgtccgttcggttacccttttacgtttaaggtttttacggtttttaaccaaacgtacgtaacgaacgtacgttaggttaaggtaacttaggtaaggttagggggttcgggttaacggggcggggaacggggtacccgaagggtccgtaccggttacccggttcggttaacggcgaaccggtcccgaacggtccgttcccgtccccgttcgggttaaccc

SEQ ID NO: 321584 - DNA, 764 bp, Homo sapiens
  misc_feature: GZ8MTXP01AI1Z5.52.31.C09.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
tcagcgcagtacgacacgaccggtgctcgatttagacgtctcatcaaggaaggaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgganatgcattgaaccaaaaaaatntgacttattggtaccagcagaggtcaggccaggcccctatatgatcatctatgaagacagacctaaaccgacccgcgtacgggactccccgtcgaagacgtacttctcgtcgggacccttacccgaagtcccgttacgaaacgggggaacctaaacggtccgggtaccctaacccgtttacggtaaccttacgtaccgaaccggggttccgggggaccccgtaggggtacggggaacggtagtacggaaacgggtccttacgggtacccttttacgttaacgggtttttcggtttttaaccaaacgtacggtaacctacggacgtaacggtttaggtaaacttaccgtaagggttaaacggggtttcgggttaacggggacggggttaaccggggaaccggttacgggtaccgttaccgggttacccggttcccggttacgggtaaccccgaccggaacccccggtaaaccggggtcccgttaccccggtcccccccggttaacggggtttccccccg

SEQ ID NO: 321585 - DNA, 675 bp, Homo sapiens
  misc_feature: GZ8MTXP01CZ85O.52.31.C09.1.454.CMB.2.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
tcagcgcagtacgacacgaccggtgctcgatttagacgtctcatcaaggaaggaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggactcacctgctctgganatgctattagaaccaaaaaatntgtacttattcggtacagcagaggtcaggccaggccctatatgatcatctatagaanacagacgaaaccgccgcgtggactcccgtnagacgtnttacgtcgtacggcctaccgacgtcgtacgaacggggtaactaacgtcgggtaccctaccgtttacgaaccttacgtaccgtaaccggtcgggggaacccctaggggtacgggaaaggtatacgggtaaacgtcgttaacgttcccttttacgtttaacggtttttacgttttaacgaaaccgttagaccgtaagtcgtaaggtacgttaacgtacgtagggttacggggttcgtcggggtacgggaacgggtaccgaggtaccgtaggacccgttcggttacggtaaccgacgtcccgtaacggtcccgttccggtaaccccgttcggtccc

SEQ ID NO: 321586 - DNA, 702 bp, Homo sapiens
  misc_feature: GZ8MTXP01BKF89.52.31.C09.1.454.CMB.2.raw
  modified_base (245)..(245): a, c, t, g, unknown or other
  misc_feature (245)..(245): n is a, c, g, or t
  modified_base (651)..(651): a, c, t, g, unknown or other
  misc_feature (651)..(651): n is a, c, g, or t
tcagcgcagtacgacacgaccggtgctcgatttagacgtctcatcaaggaaggaaggggggtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggcaggatcacctgctctggagatgcattagaaccaaaaaatntgtacttatggtacagcagaggtcgaggccaggccctatattgatcatctatagaagacagaccaaaccgcccgacgtcgggactccctacgagacgtactttctcgtcggtcctaccgtacgcgtacgaacggggaactaacgtccggtacctaaccgttacgacttacgtaccgacgggttacggggcccgtaggggtagggaaggagttacggaaggttccgtcggttacctttaccggtttaagttttcgtttttaaccgaaacgtacggtaaacgtacgtaccgtaaggttacggggttaaattcggtaaagggttacgggggttcgggttaaccggggtacggggaacggggtaccggaacggtccggtacggttaccccggttcgttacgggtaacccnccgggtaacccggacggtcccgttccccggtcccccgttcgggttaacccc

SEQ ID NO: 321587 - DNA, 753 bp, Homo sapiens
  misc_feature: GZ8MTXP01EHF37.52.31.C09.1.454.CMB.2.raw
  modified_base (249)..(249): a, c, t, g, unknown or other
  misc_feature (249)..(249): n is a, c, g, or t
tcagcgcagtacgacacgaccggtgctcgatttagacgtctcatcaaggaaggaagggggtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggcaggatcactgctctggagatgcattacgaaacctaaaaaaattntagtacttagttacggtaccgagacgaggacggtacgacggaccgacggtacccttaatagttagtactactatactaagtacgaaacgaacgaacgaaccgaaacccggacccggtacggtacgggtacctacccgtacgtacgtacgttacttcgtcgtcgtccctaacccgacgtccgtacggaacgggaacgtacgtaccgaccctacgttacgtactacgtaccgtacgggtccggggtaccggtagggtacgggaaggtagtacggacgtcgttcgttaccgtttactttaggttttacgtttttaacgaacgtaacgtacgtaacgtacgttaaggttaaaggttaacgtaggttaagggttacggggttacgggtcggggtaacgggggacggggtaaccggttacgggtaccggtacgggttacccggttccggttacggtaaccggaccggtaacccggtaacggtcccgttcccggtccccgttccggtcccg

SEQ ID NO: 321588 - DNA, 788 bp, Homo sapiens
  misc_feature: GZ8MTXP01DM699.52.31.C09.1.454.CMB.2.raw
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
tcagcgcagtacgacacgaccggtgctcgatttagacgtctcatcaaggaaggaagggggtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggatcacctgctctgganatgctaattacgaaaccaaaaaaatntgtacttagttcggtaccagcaagaggtcgacggaccacggcccctaatacttgactacattactaagtacgaaacgacgacgaaccgaaaacccgacccggtacggtacgggtaacctccccgtagaacgtaaccgtactttctacgtcggaccttaacccgacgtccgttacggaaacggggtaacctaaacggtcccgggtaccctaacgtttacgtaacttaacgtacccgtaacgggtccgggggtaacccgtagggggtacggggtaacgggtaagtacgggaaacgtccgttacggttaccctttaccgtttaaggtttttacgtttttaaaccgaaacgttaacggaacgtaacggtaccgttaaagggttaacgggttaaattacgggtaaggttaacgggggttcggggttaaccggggacggggaacgggtaccgaaagggtccgtacggttacccgggttcgttaccgggtccgaaccgggaacccgaacgggtcccgttccccggtcccccggttctaaccccg

SEQ ID NO: 321589 - DNA, 640 bp, Homo sapiens
  misc_feature: GZ8MTXP01ES3YP.52.31.C09.1.454.CMB.2.raw
  modified_base (243)..(243): a, c, t, g, unknown or other
  misc_feature (243)..(243): n is a, c, g, or t
tcagcgcagtacgacacgaccggtgctcgatttagacgtctcatcaaggaaggaagggggtgggctcaggaggcagagctctgggaatctcaccatggcctggacccctctcctgctcccctcctcactttctgcacagtctctgaggcctcctatgagctgacacagccaccctcggtgtcagtgtccccaggacaaacggccaggatcacctgctctggagatgcattagaccaaaaaatntgtacttagtcgacagacagagcacgcacgcctatatgatcatctagtagaagacacgacaaaccgaccgtcgtacggactccgtacgagtacgtacttcgtcgtcgtcctaccgagcgtacgacgggacacgtcgacctacgtacgtactacgtacgacggtcgggaccgagggtaggaggtacgtaggacgtcgtacgttacctttacgtttacgttttacgttttaacgaacgtacgaacgtacgtacgtaaggttaggtaacgtagtaacgggttcgggtcgggttaacggggacggggacgggtaccggttagggtaccgtcggttacccggttccggttaacggtccgacgtaacccggacggtccgttcccggtaaccccgttcggtccg

SEQ ID NO: 321590 - DNA, 689 bp, Homo sapiens
  misc_feature: GZ8MTXP01A6LVI.52.31.C09.1.454.CMB.2.raw
  modified_base (256)..(256): a, c, t, g, unknown or other
  misc_feature (256)..(256): n is a, c, g, or t
  modified_base (387)..(387): a, c, t, g, unknown or other
  misc_feature (387)..(387): n is a, c, g, or t
tcagcgcagtacgacacgaccggtgctcgatttagacgtctcatcaaggaaggaagggggtgggctcaggaggcagagctctgggaatctcaccatggcctggacccctctcctgcctccccctcctcactttctgcacagtctctgaggcctcctatgagctgacacacgccaccctggtgtcagtcgtcccgaggacaaacggccaggactcacctgctcgtggagatgactattacgaaacctaaaaaaattntagtacttagttacggtaccagacaaggtacggacgacggacccgacggtaccccttaatagttagacttacattactaagtagaaacgaacacgaaccgaaaccgtacccgtcggtacggacctcccganacgtaacgtctttcgtcgtcggaccctccgaacgtccgacggaaacgggacctaagtccggtacctacgttacgacttacgtacgacggtaccgggaccgtaggggtacggaggtacgtaggaacgtcgttacgttacctttacgttacgggtttacttttaacgaacgtacgtaacgagtacgtaggttacgtaactcggtagggttacgggtggttaacgggcgggttacgggacgcggtccgtacggttaccgttcgaggtccgaccgcgtacggccttccggtcccgttgtaaccccg

SEQ ID NO: 321591 - DNA, 534 bp, Homo sapiens
  misc_feature: GZ8MTXP02JE0MR.52.31.C09.1.454.CMB.2.raw
  modified_base (242)..(242): a, c, t, g, unknown or other
  misc_feature (242)..(242): n is a, c, g, or t
  modified_base (455)..(455): a, c, t, g, unknown or other
  misc_feature (455)..(455): n is a, c, g, or t
tcagcgcagtacgacacgaccggtgctcgatttagacgtctcatcaaggaaggaaggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatntgcttattggtaccagcagaggtcaggccaggcccctatattgatcatctatgaagacagaccaaaacgcccgctgggactcccctcagacgtattctctggctccagctcaggggacaagtcggcctaccttgactatcacgtcggggcccagggtcgaggataggaagctgcctttctatttgtttttcaactagactagcagtggtaaancgtagtagggtgttcggcgggagggaccgaggcgtacgaccgtcgtaggtcgacgccgacggctcgtccccgtcggtcc

SEQ ID NO: 321592 - DNA, 539 bp, Homo sapiens
  misc_feature: GZ8MTXP02IUL08.52.31.C09.1.454.CMB.2.raw
  modified_base (244)..(244): a, c, t, g, unknown or other
  misc_feature (244)..(244): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (403)..(403): a, c, t, g, unknown or other
  misc_feature (403)..(403): n is a, c, g, or t
  modified_base (432)..(432): a, c, t, g, unknown or other
  misc_feature (432)..(432): n is a, c, g, or t
tcagcgcagtacgacacgaccggtgctcgatttagacgtctcatcaaggaaggaagggggtgggctcaggaggcagagctctgggaatctcaccatggcctggacccctctcctgctccccctcctcactttctgcacagtctctgaggcctcctatgagctgacacagccaccctggtgtcagtgtccccaggacaaacggccaggatcacctgctctggagatgcattgaaccaaaaaaatntgcttaatggtaccagcagaggtcaggccaggccctatattgatcatctaanagaananagacaaacgccgngtagactccanagactatctcgtgcacagcagaggaacagtcgacctactanactacncgacgcgggacgtaggtaggagagtagancgtcgtactttacttatttagtttacaanagacagagagtagtaagtagtagtaggtaggtacggtacggacggacgacgacgtacgtaccgtacgtacgtaacgacgaccgacgacgtccgtcccgtaccgtccg

SEQ ID NO: 321593 - DNA, 617 bp, Homo sapiens
  misc_feature: GZ8MTXP02HKDLR.52.31.C09.1.454.CMB.2.raw
  modified_base (244)..(244): a, c, t, g, unknown or other
  misc_feature (244)..(244): n is a, c, g, or t
  modified_base (300)..(300): a, c, t, g, unknown or other
  misc_feature (300)..(300): n is a, c, g, or t
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
tcagcgcagtacgacacgaccggtgctcgatttagacgtctcatcaaggaaggaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaaccaaaaaatntgacttattgtaccagcagagtcaggccacggcccctatattgatcatctatgaanacagacaaaacgcccgcgtcgggactccctnagagtacttctctcggctccncgctcgaacggacaacgtcggaccacgttgactatacgacgtcggggaccctagggtacggaggagtaggaacgcgtcgtccttctttagtttcgtttttaacaacgtagacctagagtaagttacggtaattggtaaggtagggttacgggttacggggacggggtacggggaccgtaacggggtccgtacgggtaaccggtccggtacggtaaccgacggtacccgaacggtccgtacccggtcccccgttacgggttccccg

SEQ ID NO: 321594 - DNA, 667 bp, Homo sapiens
  misc_feature: GZ8MTXP02GKMF1.52.31.C09.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
tcagcgcagtacgacacgaccggtgctcgatttagacgtctcatcaaggaaggaagggggtggactcaggaggcagagctctgggaatctcaccatggcctggacccctctcctgcctccccctcctcactttctgcacagtctctgaggcctctatgagctgacacagccacctcggtgtcagtcgtcccaggacaaacggccaaggatcacctgctctgganatgctattcgaacaaaaatntgcttatcggtacagcagagtcacggccacggccctatacttgacgtcattctagtagaacgacaacgactaaaaccggccgtacgtacgggtactcccgtagtacgtacgtactttccgacgttacgggtcttacccgacgtccgttacgaacggggtaacctaaagtccgggtaacctaccgttacgtaactacgtccgtacgtcggggaccctagggttacggaggtaactgaaacgtctacggttaccttgttacgtttcgttttacgaaacgtacgtacacgtacgtaggtacgtaagtcgtaaggttcgggtacggtttacggagggtaccggtacggtacggtacgtacgtacccggttacgtacggtaacgacggtaccgtacggtccgtacccggttccccgtaacggttcccg

SEQ ID NO: 321595 - DNA, 559 bp, Homo sapiens
  misc_feature: GZ8MTXP02GC4CY.52.31.C09.1.454.CMB.2.raw
  modified_base (244)..(244): a, c, t, g, unknown or other
  misc_feature (244)..(244): n is a, c, g, or t
  modified_base (300)..(300): a, c, t, g, unknown or other
  misc_feature (300)..(300): n is a, c, g, or t
tcagcgcagtacgacacgaccggtgctcgatttagacgtctcatcaaggaaggaagggggtgggctcaggaggcagagctctgggaatctcaccatggcctggaaccctctcctgctccccctcctcactttctgcacagtctctgaggcctcctatgagctgacacagccaccctcggtgtcagtcgtccccaggacaaacggccaggatcacctgctctggagatgcattgaccaaaaaatntgcttattggtaccagcagagtcaggccaggcccctatattgatcatctatagaanacagacaaaccgccgcgtgggactccctcgagacgtattctcgtcggctccagctcgagggacaagtcgccacgtgactatcacgtcgggcccagggtgaggatgaagcgtcgcctttactatttgttttacaactacggaacacgctaggtggtaaactgtaagtaggggtggttacggggacgggacgggtaccgaggccgtcggacccgttcgaacggtcgacgacccgacggccgtcccggccccgttcggtccc

SEQ ID NO: 321596 - DNA, 562 bp, Homo sapiens
  misc_feature: GZ8MTXP02HHA76.52.31.C09.1.454.CMB.2.raw
  modified_base (553)..(553): a, c, t, g, unknown or other
  misc_feature (553)..(553): n is a, c, g, or t
tcagcgcagtacgacacgaccggtgctcgatttagacgtctcatcaaggaaggaagggggtgggctcaggaggcagagctctgggaatctcaccatggcctggacccctctcctgctccccctcctcactttctgcacagtctctgaggcctcctatgagctgacacacgccaccctcggtgtcagtcgtccccaggacagacggccaggatcacctgctctggagaggcattggacaaaacatatggatatggtaccgcagaagccaggccaggcccctgtcgttggtgatatataaagacgagggagacggccccgaggggactcccgtagacgcgatactccgtggcctcacggctacgaaggggacaaaccgtagtaccactagttacgaccatcgagtggacgtccgaaggcagaagacgaggctagacctattacgtagacctaatcgtaggacgacagccgaaggttcggttactccgtaagtggtaggttacgttcgggacggtacgggactaagcgtcgacgtccgtagtcacggaccaggccncgtaccccg

SEQ ID NO: 321597 - DNA, 656 bp, Homo sapiens
  misc_feature: GZ8MTXP02JZ468.52.31.C09.1.454.CMB.2.raw
  modified_base (244)..(244): a, c, t, g, unknown or other
  misc_feature (244)..(244): n is a, c, g, or t
  modified_base (338)..(338): a, c, t, g, unknown or other
  misc_feature (338)..(338): n is a, c, g, or t
tcagcgcagtacgacacgaccggtgctcgatttagacgtctcatcaaggaaggaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaaccaaaaaatntgtcttattggtaccagcagaggtcaggccacggcccctatacttgatcatctatgaagacagaccaaaaccgcccgcgtagggacctccctanagacgtacttcgtcgtcggcctccgagcctacgacggggaccaaagtccgggaccctaaccgttcggaaccttacgtaccgaaccgggttcgggggacccccgaagggggttcggggaagggtaagttacgggaaacggtccgttacggtacccttttacgttacgtttttacggttttaccaaacgttacgaaccgtagtaccgtaaggttagggttaaactcgtaaggttaggggttcggttacggggacgggtacgggaccgaaggtcgtacgaccgtcgtaggtcgacgccgacgcgccgtccccgcgtacccg

SEQ ID NO: 321598 - DNA, 683 bp, Homo sapiens
  misc_feature: GZ8MTXP02F81EF.52.31.C09.1.454.CMB.2.raw
  modified_base (247)..(247): a, c, t, g, unknown or other
  misc_feature (247)..(247): n is a, c, g, or t
tcagcgcagtacgacacgaccggtgctcgatttagacgtctcatcaaggaaggaaggggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagatgcattgaaccaaaaaaatntgcttattggtaccagcagaggtcaggccaggcccctatatgatcatctatagaagacagaccaaaaccgacccgcgtacgggaactcccctacaagaccgtacttccgtcgtcggtcctccagcctcgaaggggaacctaagtccgggacctaccgttagaacttactaccgaccggtcgggggacccgtaggggtagggaaggtagtaggaacgtcgttcggtacccttttacgttacgtttttacggtttttacaaacgttaacggaactaacgtacgtaaggttaagggtaaattcgtaaaggttagggggttacggttacgggggacggggtaacggggaccggtacgggtaccgtcggtaacccgttccggtaacggtaaccgaccggaccccgaacggtcccgtcccggacccccggttccggtacccg

SEQ ID NO: 321599 - DNA, 660 bp, Homo sapiens
  misc_feature: GZ8MTXP02G40XE.52.31.C09.1.454.CMB.2.raw
  modified_base (249)..(249): a, c, t, g, unknown or other
  misc_feature (249)..(249): n is a, c, g, or t
tcagcgcagtacgacacgaccggtgctcgatttagacgtctcatcaaggaaggaagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgcattcgaacctaaaaaatntgtacttattggtaccagcagagtcaggccacggcccctatactgatcatctatagaagacagacaaaccggacccgcgtacgggactcccgagaagacgtacttccgtcgtcgggtccttaccacggtccgtacggaacggggaacctaaacgtccgggtaccctaaccttttcgggaaacttacgtacccgtaacggttcgggggaccctagggggttagggaacgggtagttaggaaacgtcgttacggttacctttacgtttagtttcggtttttaacaaccgtagggtaactagacgtaggttaggtaactcggtaaggtaggggttcgttacggggacggagggacgtacggcgtcggtaccgtccgtaggaacgacgaccgacgctccgccccgtaggtacccg

SEQ ID NO: 321600 - DNA, 673 bp, Homo sapiens
  misc_feature: GZ8MTXP02GTVI6.52.31.C09.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagcgcagtacgacacgaccggtgctcgatttagacgtctcatcaaggaaggaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganatgctattgaccaaaaaaatntgcttatggtaccagcagagtcaggccagacccctatattgatcatactatagaagacacgacaaaacgccggactgggaattccccagagagtacttctcgtcggtcctaccgaagcctaccgagggggtaaaccaaaagtcggggtaacccctaacccggtttaacgtaacttacgtaccgtaccggtcggggtaccgtaaggggtacgggaacggtacgtacggtaacgtacgttacgttaccgtttacgtttaacgtttacgtttaacgtaacgtaacgtaacgtaacgtacgtacgtagttaacgtacgtaggtagggttacgggttacgggtacggggaacggtacggtacggtacggtacggtaccgtaccggtacggtaacgtacgaccgacggtaccgtaccgtacccgtaccggtacg

SEQ ID NO: 321601 - DNA, 621 bp, Homo sapiens
  misc_feature: GZ8MTXP02HRRC5.52.31.C09.1.454.CMB.2.raw
  modified_base (247)..(247): a, c, t, g, unknown or other
  misc_feature (247)..(247): n is a, c, g, or t
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (490)..(490): a, c, t, g, unknown or other
  misc_feature (490)..(490): n is a, c, g, or t
tcagcgcagtacgacacgaccggtgctcgatttagacgtctcatcaaggaaggaagggggtgggctcaggaggcagagctctgggaatctcaccatggcctggacccctctcctgctccccctcctcactttctgcacagtctctgaggcctcctatgagctgacacagccaccctggtgtcagtcgtccccgaggacaaacggccaggatcacctgctctggagatgcattcgaaaccaaaaaatntgtacttagttggtaccagcagaggtcacggccacggtcccctatatgatcatctanagaanacagacaaacgaccgcgtcggactccctgagtacgtattcctcgtcggcttccgagtccgtacgaacggacaacgttccggaccctacttacgacttactaccgtaacgggtcggggacccgtaggggttagggaaggtagttaggaacgtcgtcgtcctttactttattttcggttttanaaccgtagtacagtactaggtagtagtagtaggtgggttggtacgggacgggtacgggaacgtcggtacgtccggtaccgtaccgtacggcgaccggacgtacgccgtacccgccccgtttacggtccccg

SEQ ID NO: 321602 - DNA, 695 bp, Homo sapiens
  misc_feature: GZ8MTXP02ISZTC.52.31.C09.1.454.CMB.2.raw
  modified_base (261)..(261): a, c, t, g, unknown or other
  misc_feature (261)..(261): n is a, c, g, or t
  modified_base (313)..(313): a, c, t, g, unknown or other
  misc_feature (313)..(313): n is a, c, g, or t
tcagcgcagtacgacacgaccggtgctcgatttagacgtctcatcaaggaaggaagggggtgggctcaggaggcagagctctgggaatctcaccatggcctggacccctctcctgcctcccccctcctcactttctgcacagtctctgaggcctcctatgagctgacacacgccacccgtcggtgtcagtcgtccccgaggaacaaacggcaggactcacctgctcgtggagatcgactattacgaaacctaaaaaaattntacgttacttaagtacgacgagacgaggagcgacgcgaccgtacctatagtnatctattactagtacgaagacaacgaaccgaaacccgccgacgtacgacctaccagtacgtacgttcttcgtcgtcggtcctaccgacgtcgtacgaacggacgtacgtccgacctacgtactacgtacgacggtacggcgggtacgtaggggaggacggtagtaacggtacgtcgttccgttctttacgtttacgtttactttacgaacgtacgtacgtaggtacttaaggtagttaacgtaggttagggttacggggttacggtaccgggggacgggtaccgggtaccgtaccggtacggtacccggtaccggtaccggtacggtaaccgtacccggtaccggtacggtcccgtcccccggtacccggttcggtaacccg

SEQ ID NO: 321603 - DNA, 511 bp, Homo sapiens
  misc_feature: GZ8MTXP01D180W.3.87.H10.1.454.CMB.2.raw
  modified_base (346)..(346): a, c, t, g, unknown or other
  misc_feature (346)..(346): n is a, c, g, or t
  modified_base (425)..(425): a, c, t, g, unknown or other
  misc_feature (425)..(425): n is a, c, g, or t
  modified_base (507)..(507): a, c, t, g, unknown or other
  misc_feature (507)..(507): n is a, c, g, or t
tcagagacgcactccacgaccggtgctcgatttagcagtactgcgttgggtttggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctctggtcctggtaccaaaacaccagcaaagccccagataatgatttatgatgtcagtgatcggccctcaggggtttctcatcgtcttttcnggctcaagtctggcaacacggcctccctgaccatctctgggctccaggctgaggacgaggctgattattctgcaggctnatacacaaccgcaccatgtcgtgtttcggtggaacggcaagcttgacgtccttaggttcagcccaaggctcgccccttgtcnctcc

SEQ ID NO: 321604 - DNA, 297 bp, Homo sapiens
  misc_feature: GZ8MTXP01DAWOI.3.87.H10.1.454.CMB.2.raw
  modified_base (296)..(297): a, c, t, g, unknown or other
  misc_feature (296)..(297): n is a, c, g, or t
tcagagacgcactccacgaccggtgctcgatttagcagtactgcgttgggtttgggggtgtggtggtctccactcccgccttgacggggctgctatctgcctccctgaccatctctgggctccaggctgaggacgaggctgattatttctgcagctcatacacaaccggcaccactgtcgtggttttcggtggaggaccaagctgaccgtcctaggtcagcccaaggctgccccctggtcactctgttcccaccctcctcgagtgcgtctctgagcgggctggcaaggcgcatagnn

SEQ ID NO: 321605 - DNA, 519 bp, Homo sapiens
  misc_feature: GZ8MTXP01CQ4T9.3.87.H10.1.454.CMB.2.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (339)..(339): a, c, t, g, unknown or other
  misc_feature (339)..(339): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (456)..(456): a, c, t, g, unknown or other
  misc_feature (456)..(456): n is a, c, g, or t
  modified_base (513)..(513): a, c, t, g, unknown or other
  misc_feature (513)..(513): n is a, c, g, or t
tcagagacgcactccacgaccggtgctcgatttagcagtactgcgttgggtttggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcgtcaccatctcctgcactggatccacggtgacgttgctacttataagtttgctctggtcctggtacaaaacnccagacaaagccccagataatgatttangatgtcagtgatcgcctgagggtttctcatcgcttttcnggtctccaagtctaggcaacgacggcctcctcgaccatctctggctccgagctgagacgaggctgattagttcngcagtctanacacgacaccgcactacgtcgtcgttggttcggnggaacggacagcgttcgaccgtcgacggcacgaaccacgcctccgccccttcgtccncgtccg

SEQ ID NO: 321606 - DNA, 524 bp, Homo sapiens
  misc_feature: GZ8MTXP01DWVZC.3.87.H10.1.454.CMB.2.raw
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (460)..(460): a, c, t, g, unknown or other
  misc_feature (460)..(460): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggaacagggtcctgggcccagcctgccctgactcagcctgcctccgtgtctgggtctcctggacagtcggtcaccatctcctgcactggatccaccggtnacgttgctacttataagtttgctctggtcctggtaccaaaacnccagcaaagccccagattaaatgatttatgatgtcagtgatcggcctcaggggtttctcatcgtcttttctggctcaagtctggacaacncggcctccngaccatctctgggctcgaggctgagacgagctgtattattctgcagctacatacacgaaccgcacactgtcgttggtttcgtggnggaaccagctcgaccgtccgtagttcagcccaagctccgcccctcggttccaacttcgttcccg

SEQ ID NO: 321607 - DNA, 612 bp, Homo sapiens
  misc_feature: GZ8MTXP01CHZG5.3.87.H10.1.454.CMB.2.raw
  modified_base (272)..(272): a, c, t, g, unknown or other
  misc_feature (272)..(272): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccacggtgacgttgctacttatagtttgctctggtctggtacaaaacnccagcaaagccccagattaatgatttatgatgtcagtgatcggccctcgaggggtttctcatcgtcttttcctggtctccaagtctaacggcaacgaccggccctccctcgacctactctcgtcgggctcccgaggctggaacgggacgacgggctgtattacgtttctgccaggtctacataccaaccgaaccggcctaaccgtacttacggtcggtttacgggtttttcgggcgggaacgggtaccaaaggtccgttacggtaaccccgttccgttacggttcgacgtccccggaaaggtccgtccggcccccgttcgggtccttaaccgtttccccg

SEQ ID NO: 321608 - DNA, 518 bp, Homo sapiens
  misc_feature: GZ8MTXP01ACV49.3.87.H10.1.454.CMB.2.raw
  modified_base (232)..(232): a, c, t, g, unknown or other
  misc_feature (232)..(232): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
  modified_base (500)..(500): a, c, t, g, unknown or other
  misc_feature (500)..(500): n is a, c, g, or t
  modified_base (513)..(513): a, c, t, g, unknown or other
  misc_feature (513)..(513): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccacggtnacgttgctattatagtttgctctggtcctggtaccaaaacaccaggcaaagccccagataatgatttatgatgtcagtgatcggcccttcgtacgggggtttctcatcgtcttttctggtctccaagtctaggcaacacggcctccctgacctatctctgggctccgaggctggacggacgaggtctgtattatttctgcaggtctcatacacaaccgcacactgtcgtgtttcggngnggacagcngccgtcaggttcagccaggcncgccccttgtccntcccg

SEQ ID NO: 321609 - DNA, 582 bp, Homo sapiens
  misc_feature: GZ8MTXP01AJVML.3.87.H10.1.454.CMB.2.raw
  modified_base (241)..(241): a, c, t, g, unknown or other
  misc_feature (241)..(241): n is a, c, g, or t
  modified_base (304)..(304): a, c, t, g, unknown or other
  misc_feature (304)..(304): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagtctgccctgactcagcctccctccgcgtccggtctcctggacagtcagtcaccatctcctgcactggaaccagcagtgacattggtnattataactatgtctcctggtaccagcagcacccaggacaaacgccccaaactcatgatttangaggtacacgaaagccggccctcgacggggtccctgactcgccttctctgcctcaaagtctggcaacgaccgcctccctgaccgtctcgtcgggtcctccgacgcctggaggactggacggtcttagtaactttagttacgtggactagtccttacaattagtcgacgaggcctagtacctaaactcgttggtttccgggcgggtaacggaccgaaaggtcttcggacccgttccgtaacggtcaaccggacccgacggttccgtccgccccgtccgg

SEQ ID NO: 321610 - DNA, 546 bp, Homo sapiens
  misc_feature: GZ8MTXP01EYZ3T.3.87.H10.1.454.CMB.2.raw
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcagggggtttctcatcgcttttcctggctccaagtctggcaacacggcctccctgaccatctctgggctccaggctgaggacgaggctgattatttctgcaggctcatacacaaccggcaccactgtccgtgggttttcgtgggggtcggggaacagtcgttacgtcccgtcgttgttcaccgaaccgaggcgtcccgtcccgttcgtcttcttccg

SEQ ID NO: 321611 - DNA, 727 bp, Homo sapiens
  misc_feature: GZ8MTXP01A8HPK.3.87.H10.1.454.CMB.2.raw
tcagagacgcactccacgaccggtgctcgatttagcagtactgcgttgggtttgggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttatatctctgtctctgtaccaacaacacccagacaaacgcccccaaactcatcatttatgatgtcactgcctccggccctcgtacgggtttctctacttcccgtctttttcgtcgggtacccttcccgtaaaacgttccgtcgggacccaaccccgtaacccgggtcccccttccccgttacggaacccctaacgttcccggttccgggggcccttcccggacgggtccgttagggaaacggggaccggaagggtcctacggtactttaactttaacgttcggacgtacggtcctaacctaaagttaactaaaccgaaaggggacaacccaacctaccgtcgttccggttagggttaagttttcggggttaggggtaaaccgggaccgtaaacgggtcgttaccggttaccccggttaccgttaacggtaccgtaaccggaccccgaacgggttcccctcccggttccccccgtttcccggg

SEQ ID NO: 321612 - DNA, 526 bp, Homo sapiens
  misc_feature: GZ8MTXP01BOCLZ.3.87.H10.1.454.CMB.2.raw
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataatttgtctcctggtctggtaccaaaacaccagcaaagccccaaatcatcattatgatgtcactgctcggccctcgtagggtttctcatcgtcttttctggctcaagtctggctaaccacggccctccctcgaccatcgtcggggctccaggctgaggcgagctgcttattactgcagctcatataccgaaagacgcaccactctcgtgttattgggtgaggaccaagcgtgaccgttcgttgttcaagtcccaaggcctcgccccctggttcctaacc

SEQ ID NO: 321613 - DNA, 517 bp, Homo sapiens
  misc_feature: GZ8MTXP01AOEQF.3.87.H10.1.454.CMB.2.raw
  modified_base (310)..(310): a, c, t, g, unknown or other
  misc_feature (310)..(310): n is a, c, g, or t
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
  modified_base (479)..(479): a, c, t, g, unknown or other
  misc_feature (479)..(479): n is a, c, g, or t
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaacacccaggcaaagcccccagacttaatgatttangatgtcagtgatcggccctcgagggggtttctcgatcgcttttcctggctcaagtctggcaacacgcctccctgaccagtctctgggctccaggctgaggacgaggctgatttacttctgcaggctcanacacaacgcacactgtcgtgtttcggnggcggaccaagcngacgtcagttcagcccaggctcgccccngtcccnctcg

SEQ ID NO: 321614 - DNA, 772 bp, Homo sapiens
  misc_feature: GZ8MTXP01CE658.3.87.H10.1.454.CMB.2.raw
  modified_base (252)..(252): a, c, t, g, unknown or other
  misc_feature (252)..(252): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctctggacagtcgtcaccatctcctgcactggatccgacggtgacgttgctacttataagtttntctctggtcctaggtaaccaaaacaccaggacaaacgccccaagattaatgtatttatgaatgtacgagtagactccggtacccttcggtaacgggggtttctactacgttccggttcctttttcccgtaggtcttaccgtaaacggttcttaaccgggtaccgaaccgtacccgggtccccttaccccgttcggaacccctacgttccgtcgttcggggccccttaccggaacgggttccggtaaggaacgggtaacccggaaggggtccttagggtaaactttattttacccggtacgtaccgtacggtaccttaaccgtaaccgtaaacccgaaacccgtaaaccccgtacctaacccgtttaccggttcggtttacggggtttaccgggtttacgggacgggtaaaccggtaacccgttacggtaccgttaccggtaacccgtcggttaccggttccgacccggaacccgtaccgtcccgttccccggtaccccgttacgtcccgttcccgtcccg

SEQ ID NO: 321615 - DNA, 616 bp, Homo sapiens
  misc_feature: GZ8MTXP01EX9SU.3.87.H10.1.454.CMB.2.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
  modified_base (474)..(474): a, c, t, g, unknown or other
  misc_feature (474)..(474): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagagtcctgggcccagtctgccctgactcagcctgcctccgtgtctggtctcctggacagtcgatcaccatctctgcactggaaccaanagtgacgttgtatttttanatctntgtctctgtaccaaacaacaccaggacaaacgacccccaaactcatcatttangatgtcatgcctcggccctgtagggtttctcacttccgtctttttcgnggtcctaccgaaagttctggccaacccgaccggcccctccccgtgaccctactccgtcgggcctccgaggctggaacgggacgagggtctagtcctttaatacgtgcagtctacaattaanaacgaaggacacctaacctacttctcgggttaggtaagttttgggacgggaaacgggttacctaaacggccgttacggacccgttaccggtaacggtccgaacgtacccgaagggttccctcccggttcccccgttaaccgg

SEQ ID NO: 321616 - DNA, 712 bp, Homo sapiens
  misc_feature: GZ8MTXP01AR0Q9.3.87.H10.1.454.CMB.2.raw
  modified_base (255)..(255): a, c, t, g, unknown or other
  misc_feature (255)..(255): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttntctctgtcctggtaaccaaaacaccagcaaacgccccagataatgtatttatgatgtcagtgatcggccctcgtagggtttctctatcgtcttttctcggtctccgaagtctacggacaaccgaccggtccctccctcgacctactccgtcgtcgggtcctaccgaggtcgtaggacggaccggaggtccttggtaatttacgtttccgtacgtaccgtacggggtcttacgtaacttaaacccgaaccgaaaccccggacctaacccgtaaccgttcggttccgggtttacgggttttccggggtaacggggtaacgggtaacccgttaaacggtccggttaccggtaaccccggttacccgttaacgggttcccgttaaccgggaaccccgtaaacgggtccccgttaccccggtccccccggttccgggttaacccttaaccccgttttccccg

SEQ ID NO: 321617 - DNA, 638 bp, Homo sapiens
  misc_feature: GZ8MTXP01EEYE8.3.87.H10.1.454.CMB.2.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (456)..(456): a, c, t, g, unknown or other
  misc_feature (456)..(456): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacngtcgtcaccatctcctgcactggactccaccggtnacgttgcttacttatagtttctctctggtcctaggtaaccaaaacaccaggacaaacgcccccagattaatgtatttatgtatgtcagtgatccggccttcgtagggtttctctatcgtcttttccgcggtctacgtaagtcgtacgacaaccgtaccggtccctccctagaccctatcgtcgtcgggctccgaggctggagacgtaggcttgatttacttntacgcgacgtcttacaactaaccaacgaaccggctaccgtacgttcgtcggtttgggttttcggacgggtaacgggtaaccaaggtccgttacggtaccccgtaccgttacgggttccaaccgggtccccgaaacggtcccgtccccggtcccccgttacggttcccttaaccgtttccccg

SEQ ID NO: 321618 - DNA, 564 bp, Homo sapiens
  misc_feature: GZ8MTXP01DQFJN.3.87.H10.1.454.CMB.2.raw
  modified_base (234)..(234): a, c, t, g, unknown or other
  misc_feature (234)..(234): n is a, c, g, or t
  modified_base (255)..(255): a, c, t, g, unknown or other
  misc_feature (255)..(255): n is a, c, g, or t
  modified_base (449)..(449): a, c, t, g, unknown or other
  misc_feature (449)..(449): n is a, c, g, or t
  modified_base (488)..(488): a, c, t, g, unknown or other
  misc_feature (488)..(488): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtnacgttgctacttataagtttntctctgtcctggtaaccaaaacacccagacaaacgccccagattaatgatttatgatgtcagtgatcggccctcgtaggggtttctcgtatcgtctttttccgcggtctccaagtctagggacaacgacggccctccctcgacccatctctcgggccttccgaggctggaaggaccgaggtctagtattattcngccagctacatacacaccgcacactgtcgtggtttcggnggaacggcaagtcttagtaccgtcttacggttcacgcccgtaacgccgttccgccccgttcggtccttcgtttccc

SEQ ID NO: 321619 - DNA, 561 bp, Homo sapiens
  misc_feature: GZ8MTXP01B8B7A.3.87.H10.1.454.CMB.2.raw
  modified_base (473)..(473): a, c, t, g, unknown or other
  misc_feature (473)..(473): n is a, c, g, or t
tcagagacgcactccacgaccggtgctcgatttagcagtactgcgttgggtttgggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaacacccaggcaaagcccccagacttaatgatttatgatgtcagtgatcggccctcaggggtttctcatcgcttttcctggctccaagtctaggcaacacggccctccctgaccatctctgggctccaggctgaggacgaggctgattatttctgcaggcttcactacacaaccggcaccactcgtcgttaggttttcggngggaacgggtaccaaggtccttggacccgtccgttaagggttccaggccccaaggcctcggcccccttcgggttccaaccgtttcccg

SEQ ID NO: 321620 - DNA, 582 bp, Homo sapiens
  misc_feature: GZ8MTXP01DA02A.3.87.H10.1.454.CMB.2.raw
  modified_base (254)..(254): a, c, t, g, unknown or other
  misc_feature (254)..(254): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttntctctgtcctggtaccaaaacaccaggcaaagccccagattaatgatttatgatgtcagtgatcggccctcgagggtttctcatcgtcttttcctggctcaagtctaggcaacgacgcctccctgaccatctctcggctcaggctgagacgagctgattattctgcaggactcgaactacacgaacccggcaccgacttgtcgttaggtttcggtgggaacgggtaccaaaggtccgttacgtaacccggttccttaaacgggttcaacggtccccgaaagggtcccgttacccggccccccgttcgggtcccttaaccgtttccccg

SEQ ID NO: 321621 - DNA, 626 bp, Homo sapiens
  misc_feature: GZ8MTXP01EUWQX.3.87.H10.1.454.CMB.2.raw
  modified_base (305)..(305): a, c, t, g, unknown or other
  misc_feature (305)..(305): n is a, c, g, or t
  modified_base (454)..(454): a, c, t, g, unknown or other
  misc_feature (454)..(454): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctcgtgtctgggtctcctggacagtcgtcaccatctcctgcactggatccgaccggtgacgttgctattattagtttgtctctggtcctggtaaccaaaacaccaggcaacgccccagatatgtatttangatgtcagtgatcggccctcgtagggtttcctcatcgtcttttccgcggtctcctaagtctcgggacctaaccgccgggtccctcccgtcgaccctactcctcgtcggggcctccgaggcctggagggacgaggtctagtattacttcngcaggcttacactaccaccgaacccgctaaccgtactggttcggttcgggtttcgggacggggtaacgggtaacccaaaggtccgttcggtaaaccccgttcgttaacggttccgaccgaaccccgaaggtcccttcccggcccccgttcgggtccttaacccgtttccccg

SEQ ID NO: 321622 - DNA, 743 bp, Homo sapiens
  misc_feature: GZ8MTXP01D65VU.3.87.H10.1.454.CMB.2.raw
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
  modified_base (305)..(305): a, c, t, g, unknown or other
  misc_feature (305)..(305): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcgtcaccatctctgcactggactccgaccggtnacgttgcttaacttataagtttntctctgtcctggtaccaaaacnccagcaaagccccagatatgatttangatgtcagtgatcggccctgtagggtttctctatcgtcttttccgtggtctcgaagtctacggacaacgaccggtcccttcccgtacgaccgtactcgttcgtcggggtcctccgaggtccgttggaagggaccggtaagggtccttagggtaacttttaacgtttcgtcggtacctacggggtaccttaccgtaaaccttacccgaaacccgaaaccccgggtcctaaaccccgtaaccgtttcgggtttcccggggttttagggggttttttacccggggtggggtaaaccggggtacccgttaaacgggttcccgttaccgggtaaccccgtttaccggttaacggggttccgaccgggtaaccccggtaaacgggtccccgtttaccccggtccccccggttccgggttaaccccttaacccgttttcccccgg

SEQ ID NO: 321623 - DNA, 797 bp, Homo sapiens
  misc_feature: GZ8MTXP01C7BMQ.3.87.H10.1.454.CMB.2.raw
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctcgtgtctgggtctccgtggacagtcggtcaccatcctctgcactggactccgaccggtgacgttgcttaacttattaagtttctctcctggtcctaggtaaccaaaacnccagaccaaacgccccagtataatgtatttangtatntcgagtgacgtccggcccttgtacgggtttctacctattccgttcttttccgtcggtcttaccgaagttccgtacgggaccaaccgaccggtcccctacccgtacgtacccgtacttccgtccgtcgggtaccctaccggtacgggtacgtaggaacgggaacggtacgggtacctttaaggttaacttttaacgtttcgttacggaccgtaagtccctttaaaccgaaaccttaaacccgaaaaccccgaaaccccggtacctaaaccccgttaaccggtttcggttttccgggggttttcggggttttaccggggttaacggggtaaccggggaaacccgttaaaccggtcccggttaccggtaaccccggttaccgttacgggttccgaaccccgggttaaccccgaaacgggttccccgttccccgggtccccccgttaccggggttccccttccccggttttcccccgg

SEQ ID NO: 321624 - DNA, 766 bp, Homo sapiens
  misc_feature: GZ8MTXP01D0GHG.3.87.H10.1.454.CMB.2.raw
  modified_base (251)..(251): a, c, t, g, unknown or other
  misc_feature (251)..(251): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
  modified_base (345)..(345): a, c, t, g, unknown or other
  misc_feature (345)..(345): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctcgtgtctgggtctcctggacagtcgtcaccatctctgcactggatccgacggtgacgttgcttacttatagttntctctgtctagtacaaaacnccagcaacncccagatatgtatttangatgtcagtgactcggcccttcgtagggtttctcattcgtcttttccncggtctaccgaagtccgtaacgggaccaaccgaccgggtcccctaccccgtacgaaccctacttccgtccgtcggggtccttccggaacgggtcgtacgggaagggaacccggaggggtaccttaggttaactttacgtttcgtcggtacctaacgggtccttaccgtaaacttaaacccgaaacccgaaaccccgggtaccctaaccccgtaaaccggtttcgggttacccgggttttacggggttttttaccggggaaccgggggttaacgggaaaccccgttaaacgggtccccgtttacggtaaaccccggtttcccgttaacggggttacccgaaccggttaacccccgggaaacgggtccccgttccccgggtaccccccgttcgggttaacccccgttaaccctttccccccgg

SEQ ID NO: 321625 - DNA, 749 bp, Homo sapiens
  misc_feature: GZ8MTXP01CUHVV.3.87.H10.1.454.CMB.2.raw
  modified_base (249)..(249): a, c, t, g, unknown or other
  misc_feature (249)..(249): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcaatcaccatctctgcactggaaccaacagtgtacgttgtatttttanatctctgtctctgtacaacaacaccagacaacgaccccaaactcatacatttatgatgtcactcgtctccggccctgtacggggtttctctacttcccgttcttttcgcggtcctaccgtaaaacgttccttcgggacccaacccgtaaccgggtccccctaccccgtacggtaaaccccgtacgttcccggttaccgggggtcccttacccggaacggggtccgttacgggaaacggggaaccgggtaacggtccgttacggttactttaacgttaacgtcggtactaacggtccctaactaactaaacgttaacgaaacggtacgaacccgtaaccctaacgttccgttaccgggttagggtttaagttttcgggggttacgggtaacgggaaccgtaaacgggtccgttaaccgggttacccgttacccggtaacgggttacccgtaaccggtaccccggaacgggttcccgtccccggttcccccgttaacccggg

SEQ ID NO: 321626 - DNA, 539 bp, Homo sapiens
  misc_feature: GZ8MTXP01A9W9N.3.87.H10.1.454.CMB.2.raw
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (395)..(395): a, c, t, g, unknown or other
  misc_feature (395)..(395): n is a, c, g, or t
  modified_base (457)..(457): a, c, t, g, unknown or other
  misc_feature (457)..(457): n is a, c, g, or t
  modified_base (511)..(511): a, c, t, g, unknown or other
  misc_feature (511)..(511): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctctggtcctggtaaccaaaacnccaggcaaagcccccaaatcatgatttangaggtcacaaagccgccctgacgggtcccngactcgcttcnctcgcctcagtcngacacncgctccngcctntcnggctcagctgagntgagctagtattattactgctagctcatatgacgagcatacaactaccgttggtttccgggngggaacggtaccaaggtcgttcgaccgtccgttacggccgacgcccgaggtccncccgccccgttcgtccttaacgttcccg

SEQ ID NO: 321627 - DNA, 293 bp, Homo sapiens
  misc_feature: GZ8MTXP01A5MEG.3.87.H10.1.454.CMB.2.raw
  modified_base (292)..(293): a, c, t, g, unknown or other
  misc_feature (292)..(293): n is a, c, g, or t
tcagagacgcactccacgaccggtgctcgatttagcagtactgcgttgggtttgggggtgtggtggtctccactcccgccttgacgggctgctatctgcctccctgaccatctctgggctccaggctgaggacgaggctgattatttctgcagctcatacacaaccggcaccactgtcgtggttttcggtggaggaccaagctgaccgtcctaggtcagcccaaggctgcccctggtcactctgttcccacctctcgagtgcgtctctgagcgggctggcaaggcgcatagnn

SEQ ID NO: 321628 - DNA, 305 bp, Homo sapiens
  misc_feature: GZ8MTXP01A25IN.3.87.H10.1.454.CMB.2.raw
  modified_base (193)..(193): a, c, t, g, unknown or other
  misc_feature (193)..(193): n is a, c, g, or t
  modified_base (301)..(305): a, c, t, g, unknown or other
  misc_feature (301)..(305): n is a, c, g, or t
tcagagacgcactccacgaccggtgctcgatttagcagtactgcgttgggtttggggggtgtggtggtctccactcccgccttgacggggctgctatctgcctccctgaccatctctgggctccaggctgaggacgaggctgatttatttctgcagctcatacacaaccggcaccactgtcgtggttttcggnggaggaccaagctcgaccgtctaggtcagccaaggcctcgccccctggtcactctcgtcccgccctctcgagtgccgttctcgtggagcgggctggcaaggcgcatgnnnnn

SEQ ID NO: 321629 - DNA, 680 bp, Homo sapiens
  misc_feature: GZ8MTXP01D8FW3.3.87.H10.1.454.CMB.2.raw
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (544)..(544): a, c, t, g, unknown or other
  misc_feature (544)..(544): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcgtcacatctcctgcactggactccgacggtnacgttgcttattataagttntctctggtcctggtaaccaaaacaccaggacaaacgccccagacttaatgtatttatgatgtcagtgatccggtccctcgtagggtttctcgtatcgtctttccgcggtctaccgaagtctaggacctaacgacggccctccctgacctatctcgtacgggctaccgaggtcgtaggacgggtaacggcggtctagtatttacgtttcaggtccaggggtacctacgtaacttaaccgaccgtaaacccgggtccaaccgtacgttcggttcggtttacgggttttcgggngggtaaaccgggacgttaaacggtccgttacggtaaacccggttccgttacgggttcccgttaaccggtaaccccgtaaacggtccccgttaacccggtacccccgttcgggtaaccccttaaccgtttcccccgg

SEQ ID NO: 321630 - DNA, 633 bp, Homo sapiens
  misc_feature: GZ8MTXP01AHWE2.3.87.H10.1.454.CMB.2.raw
  modified_base (300)..(300): a, c, t, g, unknown or other
  misc_feature (300)..(300): n is a, c, g, or t
  modified_base (523)..(523): a, c, t, g, unknown or other
  misc_feature (523)..(523): n is a, c, g, or t
  modified_base (611)..(611): a, c, t, g, unknown or other
  misc_feature (611)..(611): n is a, c, g, or t
tcagagacgcactccacgaccggtgctcgatttagcagtactgcgttgggtttgggaggcctttgttggagaccttgcacttgtactccttgccgttcagccagtcctggtgcacaacggtgaggacgctgaccacacggaacgtgctgttgaactgctcctccgtggctttgtcttggcattatgcacctccacgccgtccacgtaccagttgaactggacctcgggtcttcgtggctcacgtccaccaccacgcacgtgacctcgacggggtccctcacgactctctgtcgcagcctntggattcggctttagcgacaatcgcctagtggcgttcgggtccgcgaggcctccgagggggacggggcgtgggaggtggggtacgcgtgggttagttggggtgggtgtagtaggtcgcacgacgaactacacacggtctaccgggttggacgggggtcccgttacaccgatacctaccgaagggaacgtactaaacttacccaaaaggaaccgaacggggttntaacgtccgtaggaaccaaaagtcgggaacgacggccctaggacgacgggaccggacggaccgacggtccgtaatttaacgttaacgnggttacgaacggttaagttaag

SEQ ID NO: 321631 - DNA, 779 bp, Homo sapiens
  misc_feature: GZ8MTXP01CXCDU.3.87.H10.1.454.CMB.2.raw
tcagagacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctcgtgtctgggtctctggacagtcgtcaccatctctgctactggactccgaccggtgtacgttgacttaacttattaagtttcgtcctccgtggttcctacggtaaacccaaaaaccaccccgaaggaccaaaccgcccccaagtaattaactagtatttatgtatgtcagtgacgtccggcccgttgtacgggtttctcgtacttcgttcttttcccgtcggtacctacgtaacgttccgtaacgggacctaacccgtcccgggtaccccttccccgtacgaccctacttccgtccggtcggtacctccggacgtcgtagggacggacggtacgggtactagttagtttacttcgtacgtactagggtacccttactaacctaacccgaaacccggaaccccggtacctaacccggttaccggttcgggttccgggttttaggggttttacccggggtaggggaaaccggtaacccggttaacggtcccgttaccgggtaaccccggttaccggttaaccgggttccgacccgggttaaccccggaaccgggttcccgtccccggtcccccggtttaccggtcccgttccgtttccccccgg

SEQ ID NO: 321632 - DNA, 646 bp, Homo sapiens
  misc_feature: GZ8MTXP01D7TNW.3.87.H10.1.454.CMB.2.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
  modified_base (283)..(283): a, c, t, g, unknown or other
  misc_feature (283)..(283): n is a, c, g, or t
  modified_base (450)..(450): a, c, t, g, unknown or other
  misc_feature (450)..(450): n is a, c, g, or t
tcagagacgcactccacgaccggtgctcgatttagcagtactgcgttggggtttggggggggtctcaggaggcagcgctctcgggacgtctccaccatggcctgggctctgctattcctcaccctcctcactcagggcacagggtcctgggcccagcctgccctgactcagcctgcctcgtgtctgggtctctggacagtcgtcacatcctctgcngtgactccgtacggtgtacgttntacttacttattagttctctcgttcgtctacgtaaaccaaaacnccaaggacaaacgccccagtaacttaatagtattatgatgtcagtgactccggtcccttacggtcggttctctactcgttcttttccgcggtctactacgtctacgtaccaacgaccgtccctccctcgaactctcgtcgcgtctacgaggcgtagaggaacgtcgngttatattactcgtagccagtactacaaacctacccgaaccgaacccgccctacgtaccgtttcggtacggtttcggggtttacggacgggtaacgaaccgttaaagtccgttacggaccttaccggttaacgttcgaaccgccccgtaacgggtcccttacccggccccggttactccgttaacccgtttccccg

SEQ ID NO: 321633 - DNA, 714 bp, Homo sapiens
  misc_feature: GZ8MTXP01EKU0W.3.87.H10.1.454.CMB.2.raw
  modified_base (328)..(328): a, c, t, g, unknown or other
  misc_feature (328)..(328): n is a, c, g, or t
tcagagacgcactccacgaccggtgctcgatttagcagtactgcgttggggtttggggggggtctcaggaggcagcgctctcgggacgtctccaccatggcctgggctctgctattcctcaccctcctcactcagggcacagggtcctgggcccagcctgccctgactcagcctgcctcgtgtctgggtctcctggacagtcgtcaccatctcctgctacgtggactccgacggtgtacgttgacttaacttataagtttctctcgtcggtcctaggtaaaccaaaacaccaggacaaaccgcccaagattaatgtatttatgatgtnagtgactccggtacccttcgtacgggtttctctacgttcgttcttttccgcggtactcgaagtcgtaacgacaaccgcgtccctacctcgacctactctcgtcgggtcctacggacggctacggaacgggtacgacggtcttaggttactttaacgtttcgtacgtaccgtacgggtacctactaaaccttaaccgaacccgaaaccccggacctaaacccgtcgtttacgggttccggtttagggggtttttccgggagggtaaacgggtaacccgttaaacggtcccgttacggtaccccgggttaacgttacgggccggaacccgtaacccggtaacggtccgtaccccgtccccggttaccggtcccttaaccgtttccccg

SEQ ID NO: 321634 - DNA, 631 bp, Homo sapiens
  misc_feature: GZ8MTXP01C6009.3.87.H10.1.454.CMB.2.raw
  modified_base (570)..(570): a, c, t, g, unknown or other
  misc_feature (570)..(570): n is a, c, g, or t
tcagagacgcactccacgaccggtgctcgatttagcagtactgcgttgggtttgggaggcctttgttggagaccttgcacttgtactccttgccgttcagccagtcctggtgcacaacggtgaggacgctgaccacacggaacgtgctgttgaactgctcctccgtggtctttgtcttggctattatgcacctccacgccgtccacgtaccagttgaactggaccgtcgggtcttcgtgctcacgtccaccaccacgcacgtcgaccctcgacggggtccctcacgacctcctccgtgtcgcacgtccctcgtggtatttccggctttagcgacaagtgcctagtgggtccgttcgggtcccgccgaggccgtaccggagggggaaggggcgtgggaggtggggtcgcgttggtagttgggtggtgtacgtagtcgacgagtacactacgacgtacgtcgtaccggtggacggggtcccgttacgacctacttccgaccgaagggacgtaaacctaaattacccgaaaaggtaaccgacgggttataacgtctacggacaaagtggaacncgacctggacgacggtccggaggacgacggtctatttcgtaagtgttagaacgttaaagtg

SEQ ID NO: 321635 - DNA, 662 bp, Homo sapiens
  misc_feature: GZ8MTXP01D0BX6.3.87.H10.1.454.CMB.2.raw
  modified_base (289)..(289): a, c, t, g, unknown or other
  misc_feature (289)..(289): n is a, c, g, or t
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
tcagagacgcactccacgaccggtgctcgatttagcagtactgcgttgggtttgggggggggtctcaggaggcagcgctctcgggacgtctccaccatggcctgggctctgctattcctcaccctcctcactcagggcacgagggtcctgggcccagcctgccctgactcacgcctgcctcgtgtcgtgggtctccgtggacagtcgtcacatcctctgctatgactccgacggtgtacgttgacttacttattagttcgtcctcgtcgtacctagtaaaccaaaaccnccgaaggaccaaacgccccaagtattaagtgttatttangtatgtacagtagtacgtccgtacccgttgtacgggtttntcgtacttcgttctttcgcgtctacgtagtcgtaacgaccaaccgtccggtccctccctacgacctacgttcgtacgtcggtcccgtcggacggtcgttacgggacgtaacggtcgggtacttaggttaactttacgtttcgagtcgtacgtactaacgtacaaccgacgaacccgctaccgtacgttcggttacggtttgggttacggcgggaacggacaggtccttacgacgttacgttgttaccgttaccaaccgtaggtccgttaccggcccttggtccttcgttccccg

SEQ ID NO: 321636 - DNA, 687 bp, Homo sapiens
  misc_feature: GZ8MTXP01DI0YC.3.87.H10.1.454.CMB.2.raw
  modified_base (199)..(199): a, c, t, g, unknown or other
  misc_feature (199)..(199): n is a, c, g, or t
  modified_base (256)..(256): a, c, t, g, unknown or other
  misc_feature (256)..(256): n is a, c, g, or t
  modified_base (303)..(303): a, c, t, g, unknown or other
  misc_feature (303)..(303): n is a, c, g, or t
  modified_base (679)..(679): a, c, t, g, unknown or other
  misc_feature (679)..(679): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacngtcggtcaccatctctgcactggactccgacggtgacgttgcttacttataagtttntctctgtcctggtaaccaaaacaccagacaacgacccagacttaatntatttatagtatgtcgagtgtactccggtcccgttcgtacgggtttctactacttcgtctttttccgtcggtactcgtaacgtcgtacgaccgtaacgaccgtcccttacccgtaccgtacctacttcgtccgttcggggccttaccgacgggtcgtagggaacgggtaacgtacgggttcttaggttaactttactttcgtcgtactaacgggttacctacgtaaacttaacccgaaacccggtaaacccgcccgtaacgtaaccgtttcggtttcgggttttacgggtttcggtaagggtaaccggacgttaaacgtcgttacgttaccgtccgttagttccgcgtaaccccgagtcgtcccgcccttcgtccncgttcccg

SEQ ID NO: 321637 - DNA, 687 bp, Homo sapiens
  misc_feature: GZ8MTXP01DZ2CI.3.87.H10.1.454.CMB.2.raw
  modified_base (535)..(535): a, c, t, g, unknown or other
  misc_feature (535)..(535): n is a, c, g, or t
  modified_base (554)..(554): a, c, t, g, unknown or other
  misc_feature (554)..(554): n is a, c, g, or t
  modified_base (600)..(600): a, c, t, g, unknown or other
  misc_feature (600)..(600): n is a, c, g, or t
  modified_base (662)..(662): a, c, t, g, unknown or other
  misc_feature (662)..(662): n is a, c, g, or t
  modified_base (677)..(677): a, c, t, g, unknown or other
  misc_feature (677)..(677): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagggtcctggcccagcctgccctgactcagcctgcctcgtgtctgggtctcctggacagtcggtcaccatcctctgctacgtggatcccgaacggtgtacgttgaccttaacttattaacgtttcgtacctccgtcggtccgtacggtaaacccaaaaaccacccgaacggaccaaacgaccccccaagtaatttaaactagtatttaagtgtatagtcgtagtaggtacgttccggtaccctttacggtacgggggttttcctactacttccgttaccttttccgcgggtacttaccgtaagttccgtacgggaccaaccgtaccgggcccttaccccgtacgaacctgtcttcgtcgggcttccgaggcctaggaggacgaggtcgtagtattnttcttacgctgtaccttanaactacaacgaccgtccaacctacgtgtttcggttgggtttacggngggaacggcgttaaggtcgttcgtaaccgtcgttaacgttcgaccgccgtaacgccgttccnccccgttggtaaccncgtttcccgg

SEQ ID NO: 321638 - DNA, 513 bp, Homo sapiens
  misc_feature: GZ8MTXP02JFFU6.3.87.H10.1.454.CMB.2.raw
  modified_base (456)..(456): a, c, t, g, unknown or other
  misc_feature (456)..(456): n is a, c, g, or t
tcagagacgcactccacgaccggtgctcgatttagcagtactgcgttgggtttgggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagttgtctcctggtcctggtaccaaaacacccaggcaaagcccccagattaatgatttatgatgtcagtgatcggccctcaggggtttctcatcgtctttcctggtctccaagtctggcacacgcctcctgaccatctctggctccaggctgagacgaggctgattattctgcagctcatacacaaccggcaccactgtcgtggtttcgnggtaggaccaagctgaccgtctacggtcagccaaggctcggcccctcggtcactccg

SEQ ID NO: 321639 - DNA, 518 bp, Homo sapiens
  misc_feature: GZ8MTXP02F7K2P.3.87.H10.1.454.CMB.2.raw
  modified_base (459)..(459): a, c, t, g, unknown or other
  misc_feature (459)..(459): n is a, c, g, or t
tcagagacgcactccacgaccggtgctcgatttagcagtactgcgttgggtttggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaacacccaggcaaagcccccagattaatgatttatgatgtcagtgatcggccctcaggggtttctcatcgcttttcctggctcaagtctggcacacggcctccctgaccatctctgggctccagctgagacgaggctgattattctgcagctcatacacaaccggcaccactgtcgtggtttcggnggacggaccagctgaccgtctaggtcagccctaaggctcgccccctcggtccacttccg

SEQ ID NO: 321640 - DNA, 536 bp, Homo sapiens
  misc_feature: GZ8MTXP02HADTC.3.87.H10.1.454.CMB.2.raw
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctctgtcctggtaccaaaacaccagcaacgccccagataatgatttatgatgtcagtgatcggccctcgtaggggtttctctatcgtctttcctggcctccaagtctaggcaccgacggcctcccgtgaccatctcgtgggcctccgagctgagacgaggctagtattattctgcagcttcaactacaacaaccgcaccacgtgtcgttggtttcggaggacggaccagctagaccgtcgtacggtcacgccgaacggctccgccccgtcgtccacttccg

SEQ ID NO: 321641 - DNA, 547 bp, Homo sapiens
  misc_feature: GZ8MTXP02GOB67.3.87.H10.1.454.CMB.2.raw
  modified_base (420)..(420): a, c, t, g, unknown or other
  misc_feature (420)..(420): n is a, c, g, or t
  modified_base (479)..(479): a, c, t, g, unknown or other
  misc_feature (479)..(479): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgcttacttataagttgtctctgtctgtaccaaacaccagcaacgccccagatatgtatttatgatgtcagtgagtcggccctcgtaggggtttctcatcgtctttccgtggtcctaccaagtctcggcaccgaccggtcctcccgtcgaccctatctcgtgggcctccgagctgacggacgnggctgatttattctgcagtctacactacacaacccgcacctactgtcgttggtttcggnggtacggaccagcgtacgaccgtcgtacgtcacgccgacggcctccggcccctacggtccacgttccg

SEQ ID NO: 321642 - DNA, 510 bp, Homo sapiens
  misc_feature: GZ8MTXP02FSSRU.3.87.H10.1.454.CMB.2.raw
  modified_base (423)..(423): a, c, t, g, unknown or other
  misc_feature (423)..(423): n is a, c, g, or t
  modified_base (455)..(455): a, c, t, g, unknown or other
  misc_feature (455)..(455): n is a, c, g, or t
tcagagacgcactccacgaccggtgctcgatttagcagtactgcgttgggtttggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaacacccaggcaaagcccccagattaatgatttatgatgtcagtgatcgccctcaggggtttctcatcgcttttcctggctcaagtctggcacacgcctccctgaccatctctgactccagctgagacgaggctgattattctgcagctnatacacaaccgcaccactgtacgtgtttcggnggacggtaccaagctgaccgtccgtagtcagccgaagctcgcccctcgcactccg

SEQ ID NO: 321643 - DNA, 586 bp, Homo sapiens
  misc_feature: GZ8MTXP02IVY49.3.87.H10.1.454.CMB.2.raw
  modified_base (254)..(254): a, c, t, g, unknown or other
  misc_feature (254)..(254): n is a, c, g, or t
tcagagacgcactccacgaccggtgctcgatttagcagtactgcgttgggtttgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcggtcaccatctcctgcactggatccaccggtgacgttgctacttataagttntctctgtctgtaccaaacaccagcaagccccagattaatgatttatgatgtcagtgatcggccctcgaggggtttctcatcgtcttttcctggtcctccaagtctggaccacgaccggtccctcccctcgacccatccttcgtcggggccttcccaggccgtaggaagggacgagggctggtattattctgctagcttcactacaaccgaacccgccaacctactcggtcgttacgggtttcggtacggacgggtacccaaggtcctacggaccgttccgtaacggtccaacgaaccgtaacggctaccggccccctcggtccacgttcccg

SEQ ID NO: 321644 - DNA, 554 bp, Homo sapiens
  misc_feature: GZ8MTXP02JA7DV.3.87.H10.1.454.CMB.2.raw
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctattataagtttgtctctgtcctgtaaccaaaacaccagcaaacgccccagataatgatttangatgcagtgatcggcctcgagggtttcnctatcgtctttcctgctcaagtctaggcacacgcctccctgaccatctcgtggcctcaggctggagacgagctagtattattctgcagctcatacaacaaccgcacctactcggttcgttggttttcgggaggtacggtaccgaaagtccgtacggacccgtcgtacggttaccaacggcccgaaacggtccttaccggccccctacggtcctacctttcccg

SEQ ID NO: 321645 - DNA, 559 bp, Homo sapiens
  misc_feature: GZ8MTXP02JZ3X3.3.87.H10.1.454.CMB.2.raw
  modified_base (248)..(248): a, c, t, g, unknown or other
  misc_feature (248)..(248): n is a, c, g, or t
  modified_base (301)..(301): a, c, t, g, unknown or other
  misc_feature (301)..(301): n is a, c, g, or t
  modified_base (489)..(489): a, c, t, g, unknown or other
  misc_feature (489)..(489): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctctgtaccaacaacaccagacaaacgccccaactcatcatttangatgtcactgctcggcctcgtaggggtttctctatccgtctttctggcctcaagttctggccaccgaccggtccctccctcgacctactccgtccggggcctccgacggctgacggacgacggctgtcttattactgcagctacatataacgaaggacaccaacactctacggtggttagtttagggnggacgggaaccaggtaccgtacgacccgttcgtaacggtcgaccgccgaacggtcctccggccccgtcgg

SEQ ID NO: 321646 - DNA, 540 bp, Homo sapiens
  misc_feature: GZ8MTXP02J0IF0.3.87.H10.1.454.CMB.2.raw
  modified_base (429)..(429): a, c, t, g, unknown or other
  misc_feature (429)..(429): n is a, c, g, or t
  modified_base (467)..(467): a, c, t, g, unknown or other
  misc_feature (467)..(467): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctctggtcctggtaccaaaacaccagcaaagcccccagattaatgatttatgatgtcagtgatccggccctcaggggtttctcatcgtcttttcctgctccaagtctggcacgacggccctccctgaccatctctcgggcctccaggctgaggacgaggctgatttattctgcngctcatacacaccgcaccacgtcgtcgttggtttcggnggacggtacaagctacgaccgtccgtacgtccgacgcccgaacggtccgtacgccccgtcgtccgaccttccg

SEQ ID NO: 321647 - DNA, 735 bp, Homo sapiens
  misc_feature: GZ8MTXP02GBO4Q.3.87.H10.1.454.CMB.2.raw
  modified_base (247)..(247): a, c, t, g, unknown or other
  misc_feature (247)..(247): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagagtcctgggcccagtctgccctgactcagcctgcctcgtgtctggtctcctggacagtcgatcaccatctcctgcactggaaccaacagtgacgtttgtatttttanatctctgtctctgtaccaacaacaccaggacaaacgcccccaaactcatctatttatgatgtcactgctccggccctcgtaggggtttctctacttccgtcttttcgtcggtcctaccgtaacgttcgtcgggacctacccgaccgggtccccttccccgtcgaaaccctcgtccgtccgggggtacccttcccggaagggtccgtacggggacgggaccggtaacgggtcccgttaggttacctttaacgtttaaccgtcgtaccgtacggtccttacctaagtttaaacgtaaacccgtaaagggggaaccgtacccgtaaccccttaaccgttccgtttaccgggttacgggtttaaggtttttacgggggaacgggtaaccgggggtaaaccctaaacgggtcccgttacggtaccccggtttaccggtaacggttaccgaccggtacccgaacggtccgtaccccggtcccccgtttacccgg

SEQ ID NO: 321648 - DNA, 547 bp, Homo sapiens
  misc_feature: GZ8MTXP02F0DHK.3.87.H10.1.454.CMB.2.raw
  modified_base (233)..(233): a, c, t, g, unknown or other
  misc_feature (233)..(233): n is a, c, g, or t
  modified_base (310)..(310): a, c, t, g, unknown or other
  misc_feature (310)..(310): n is a, c, g, or t
  modified_base (356)..(356): a, c, t, g, unknown or other
  misc_feature (356)..(356): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
  modified_base (481)..(481): a, c, t, g, unknown or other
  misc_feature (481)..(481): n is a, c, g, or t
  modified_base (540)..(540): a, c, t, g, unknown or other
  misc_feature (540)..(540): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggactccacggtnacgttgcttacttataagtttgtctctggtcctggtaccaaaacacccaggcaaacgcccccagattaatgatttangatgtcagtgatcggccctcgtaggggtttctcatcgtcttttccnggtctacaagttctcggacacgaccggcctccctgacctatctcgtgggcctccgaggtctggacggacgagctgtattattntgcagctnactacacaaccgcacactgtcgttaggtttcggngacggacaagctacgaccgtcgtaacggtcagaacccgaggcctccggccctcggtacncttcccg

SEQ ID NO: 321649 - DNA, 585 bp, Homo sapiens
  misc_feature: GZ8MTXP02ITSCN.3.87.H10.1.454.CMB.2.raw
  modified_base (310)..(310): a, c, t, g, unknown or other
  misc_feature (310)..(310): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatcctcctgcactggatccaccggtgacgttgcttacttataagtttgtctcctgtcctggtaccaaaacaccaggcaaagcccccagacttaatgatttangtatgtcagtgatccggccctgtaggggtttcctcatcgtctttttctcggtctccaagttctggacaccaccggtccctccccgtacgaccctatcctcgtcgggcctcccgagccgtggagggacgagggtctagtaatttatttctggcctagctcaactacaccaaccggcaccagttcgtcggttaggtttcggaggtacgggacaagctacggaccgttcgtacggtccacgcccgaacggcctccgccccgtcggtcctacgttcccg

SEQ ID NO: 321650 - DNA, 523 bp, Homo sapiens
  misc_feature: GZ8MTXP02HJIOP.3.87.H10.1.454.CMB.2.raw
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagttgtctctggtcctggtaccaaaacacccaggcaaagcccccagataatgatttatgatgtcagtgatcggccctgaggggtttctctatcgtctttccngctccagtctggcacacggcctccctgaccatctcgngggtctccgaggctaggaggacgaggctgtaactttattctagcagtctacactacaacgaccgcacctactgtcgttggtttcggaggtacggacagctgaccgtcgtagcagcgaggctcgccctcgcactccg

SEQ ID NO: 321651 - DNA, 601 bp, Homo sapiens
  misc_feature: GZ8MTXP02I7703.3.87.H10.1.454.CMB.2.raw
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggactccacggtnacgttgctacttatagtttnctctgtcctggtaccaaaacaccagcaaacgccccaagataangatttangtatgtcagtgatcggccctcagggttcncatcgtctttccngctcaatctggcactacgcctccctgacctatctctcggcctcgacgctggacgacgacggctaggtatttacgtttctaggtccaggtaccttacaacttaaccaaccgtaaacccgggacctaaccctaacgttcggttccggtttacggggtttttcgggagggtacggggaccaaacggtccgtacgtacccgttcgtaacgggtccaacggcccgaacggccctcggccccctcggtaccacgtttccccg

SEQ ID NO: 321652 - DNA, 575 bp, Homo sapiens
  misc_feature: GZ8MTXP02FQC93.3.87.H10.1.454.CMB.2.raw
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (312)..(312): a, c, t, g, unknown or other
  misc_feature (312)..(312): n is a, c, g, or t
  modified_base (334)..(334): a, c, t, g, unknown or other
  misc_feature (334)..(334): n is a, c, g, or t
  modified_base (362)..(362): a, c, t, g, unknown or other
  misc_feature (362)..(362): n is a, c, g, or t
  modified_base (429)..(429): a, c, t, g, unknown or other
  misc_feature (429)..(429): n is a, c, g, or t
tcagagacgcactccacgaccggtgctcgatttagcagtactgcgttgggtttgggggggtctcaggaggcagcgctctcgggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnatttanaactntgtctctggtaccagcagcacccaggcaaacgcccccaaatcatgatttatgaggtcanaaagccgccctgacgggtcccngatcgccttctctgcctcagtctgcacncgcctcctgaccgtctcgtcggcctccacgcctgagatgaggctagtattactatgcagctacatangtacacggacatactaacgtacgtttcggtttacgggacgggtaacgggaaccgtaacggtccgtaccggtaccccgttaccggttaacggtacccgaaccggaccccgtaaacgggtcccgtacccggtacccccgtttcccggg

SEQ ID NO: 321653 - DNA, 575 bp, Homo sapiens
  misc_feature: GZ8MTXP02G2B24.3.87.H10.1.454.CMB.2.raw
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (490)..(490): a, c, t, g, unknown or other
  misc_feature (490)..(490): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagttgtctctgtcctgtaccaaaacnccaggcaaagccccagataangtatttatgatgtcagtgatcggccctgtagggtttctctatcgtctttctgctccaagtctggctaccgacggcctcccgtagacccagtctccgtgggcctccgagcgtggacggacgaggctagtatttagttctgctagtctacaataccgacaacccggcaaccgtactcgttcggttcggttttacggnggtaacgggacctaaggctacgacccgttacgtacgtccacgaacccgaacggcctccgcccccgtcggtacctaccgtttcccg

SEQ ID NO: 321654 - DNA, 526 bp, Homo sapiens
  misc_feature: GZ8MTXP02G6JG0.3.87.H10.1.454.CMB.2.raw
  modified_base (425)..(425): a, c, t, g, unknown or other
  misc_feature (425)..(425): n is a, c, g, or t
  modified_base (458)..(458): a, c, t, g, unknown or other
  misc_feature (458)..(458): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgctcctggtcctggtaccaaaacaccaggcaaagcccccagataatgatttatgatgtcagtgatcggccctcgaggggtttctcatcgtctttcctgctcagtctggcacacggcctcctgaccatctctggctccgagctgaggacgaggctgtattattctagcagctnatacacaccgcaccactgtacgttggtttcggnggaacggaccaagctacggaccgtccgtacggtcacgccgaagcctcgccccgtcggtccacgttccc

SEQ ID NO: 321655 - DNA, 624 bp, Homo sapiens
  misc_feature: GZ8MTXP02HYDKJ.3.87.H10.1.454.CMB.2.raw
  modified_base (281)..(281): a, c, t, g, unknown or other
  misc_feature (281)..(281): n is a, c, g, or t
  modified_base (455)..(455): a, c, t, g, unknown or other
  misc_feature (455)..(455): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccgaccggtgacgttgacttacttattaagttgtctcctggtcctggtaccaaaacnccaggcaaacgccccagtacttaatgtatttatgatgtcagtgacgtcggccctcgtagggtttctctatcgttctttccgtgtcctacacgtctggacaccgcgtccctccctcgaacctactctcgtcgggcctaccgagctaggacggacgaggtcttagatttagtttcnggtacagtcttacgaacttaccaaccgaacccggacaaccctacgttcggttacggtttgggttttaccgggagggtacgggaccaaagtccgtacggaccgtccgtacggtacccacggtaaccccgaaggtcccgtcccggaccccgttacggtcctactttccccg

SEQ ID NO: 321656 - DNA, 500 bp, Homo sapiens
  misc_feature: GZ8MTXP02HB098.3.87.H10.1.454.CMB.2.raw
  modified_base (271)..(271): a, c, t, g, unknown or other
  misc_feature (271)..(271): n is a, c, g, or t
  modified_base (328)..(328): a, c, t, g, unknown or other
  misc_feature (328)..(328): n is a, c, g, or t
  modified_base (364)..(364): a, c, t, g, unknown or other
  misc_feature (364)..(364): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (407)..(408): a, c, t, g, unknown or other
  misc_feature (407)..(408): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (440)..(440): a, c, t, g, unknown or other
  misc_feature (440)..(440): n is a, c, g, or t
tcagagacgcactccacgaccggtgctcgatttagcagtactgcgttgggtttgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcggtcaccatctcctgcactggatccaccggtgacgttgctacttatagtttgctctgtctgtacaaacnccagcaacgccccagataatgatttatgatgtcagtgatcgccctcgtagggtttcncatcgtctttcctgctcagtctggcacacgcctccngaccatctcgtggctccgagctgagtacggngntgtattatcnnanctanacacacacgcactgtgtcgttgtcgnggacgacagctcgtaccgtcgtacgcgacgaaccgacgcctccgcccgtcgtctacctcg

SEQ ID NO: 321657 - DNA, 526 bp, Homo sapiens
  misc_feature: GZ8MTXP02GYV7C.3.87.H10.1.454.CMB.2.raw
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
  modified_base (407)..(407): a, c, t, g, unknown or other
  misc_feature (407)..(407): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtnacgttnctacttataagttntctctgtctgtacaaacnccagcaagccccagataatgatttatgatgtcagtgatcggccctgacgggtccctgattgcttcctctcgcctcagtctcggctaacacggtccctccctcgaccgtctcgtcgggcctccagcctgaggatggngtctagtattattactgcagctcatatgacagcataccaagtacttgtttccggcgggacggacaagctacggacccgtcgtacgcgacgaccgacggcctccggacccccgtcggtcc

SEQ ID NO: 321658 - DNA, 526 bp, Homo sapiens
  misc_feature: GZ8MTXP02F8C18.3.87.H10.1.454.CMB.2.raw
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
  modified_base (401)..(401): a, c, t, g, unknown or other
  misc_feature (401)..(401): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggactccacggtgacgttncttattatagtttnctctgtctgtacaaacnccagcaagccccagataatgatttatgatgtcagtgatcggccctcgaggggtttctcatcgtctttcctggctcagtctgcacgacgcctcctgacctatcctctcgggctccgaggtctggacgacggnggtctgtacttattccgtgcagctcactacaccaccgcacacgtgtcgttggtttcggaggtacggactagcgtcgaccgtctacggtcacgtcccgaaggcctccgcccctcggtcacttcccg

SEQ ID NO: 321659 - DNA, 571 bp, Homo sapiens
  misc_feature: GZ8MTXP02JANQE.3.87.H10.1.454.CMB.2.raw
  modified_base (253)..(253): a, c, t, g, unknown or other
  misc_feature (253)..(253): n is a, c, g, or t
  modified_base (352)..(352): a, c, t, g, unknown or other
  misc_feature (352)..(352): n is a, c, g, or t
  modified_base (437)..(437): a, c, t, g, unknown or other
  misc_feature (437)..(437): n is a, c, g, or t
  modified_base (480)..(480): a, c, t, g, unknown or other
  misc_feature (480)..(480): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccacggtgacgttgctacttataagtttnctcctggtcctggtaaccaaaacaccaggcaaacgcccccagattaatgatttatgatgtcagtgatcggccctgaggggtttctcatcgtcttttccnggtctcaatctggcacacggccctcctcgaccatctcgtgggcctccgaggctgagggacgaggcttgattattcgtgcagcttnataccgaccaaaccggcaccacgttcgtcgttgggtttcgggnggtaacggggaccaaaggtccgtacgtacccgtccgtaacggtccaacgcccgaacggcctccggcccccgtacggtcctaccgtttcccg

SEQ ID NO: 321660 - DNA, 656 bp, Homo sapiens
  misc_feature: GZ8MTXP02GTCUZ.3.87.H10.1.454.CMB.2.raw
  modified_base (252)..(252): a, c, t, g, unknown or other
  misc_feature (252)..(252): n is a, c, g, or t
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (333)..(333): a, c, t, g, unknown or other
  misc_feature (333)..(333): n is a, c, g, or t
  modified_base (367)..(367): a, c, t, g, unknown or other
  misc_feature (367)..(367): n is a, c, g, or t
  modified_base (391)..(391): a, c, t, g, unknown or other
  misc_feature (391)..(391): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctggacccagcctgccctgactcagcctgcctccgtgtctgggtctcctggacagtcggtcaccatctcctgcactggatccacggtgacgttgctacttatagtttntctctggtcctggtaccaaaacnccagcaacgccccagattaangtatttatnatgtcagtgatcggccctgagggtttcncatcgtctttctgctcgatctgcacgcgcctccngaccatctcgtaggctcgagtcgngaggacgagtctagtatttacttcgtagctagtcttcaacttaccaaccgaaaccccggacaaccctacgttcggttcccggtttaggggtttttaccggggacgggtaaacggggtaacccgtaaaaggtcccggttaccggaaccccggtttacccgtaaacggggtttaccccaaccggggaacccccgtaaaacgggggtcccctttacccccggtacccccccggtttccggggttacccctaaccgttttaccccccgg

SEQ ID NO: 321661 - DNA, 673 bp, Homo sapiens
  misc_feature: GZ8MTXP02IM9EP.3.87.H10.1.454.CMB.2.raw
  modified_base (198)..(198): a, c, t, g, unknown or other
  misc_feature (198)..(198): n is a, c, g, or t
  modified_base (283)..(283): a, c, t, g, unknown or other
  misc_feature (283)..(283): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacngtcggtcacatctcctgcatggactccgacggtgacgttgcttaacttattagtttcgtctcctggtcctaggtaaccaaaaacnccagacaaacgcccccagattaatgtatttatgatgtcagtgagtcgcccttcgtagggtttctctactcgtctttttcgcggtcctccgaagttcgttcgggaccaaccgtccggtccccttaccctcgtaaaccctctccgttcggtcggtccttacccggacggtcgtggacgggaaacgtcgggtacttagtagtttactttcgtcggtacacggtccttaacgaacttaccaacccgaaaccggcctaaacctcgttggtttccgggtttggtttacggggttagggaccgggtaaccgtaaaggtccttacggggacccgtttaccgtacggtccgacgaaccgtaacggcccgtcccggtcccctcgggtacctctttccccg

SEQ ID NO: 321662 - DNA, 526 bp, Homo sapiens
  misc_feature: GZ8MTXP02HMVIE.3.87.H10.1.454.CMB.2.raw
  modified_base (233)..(233): a, c, t, g, unknown or other
  misc_feature (233)..(233): n is a, c, g, or t
  modified_base (355)..(355): a, c, t, g, unknown or other
  misc_feature (355)..(355): n is a, c, g, or t
  modified_base (440)..(440): a, c, t, g, unknown or other
  misc_feature (440)..(440): n is a, c, g, or t
  modified_base (470)..(470): a, c, t, g, unknown or other
  misc_feature (470)..(470): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtnacgttgctacttataagtttgtctcctggtcctggtaccaaaaacacccaggcaaagcccccagacttaatgatttatgatgtcagtgatcggccctcgaggggtttctcatcgcttttccnggctcaagtctggcacacggcctcctgaccatctctgggctccgaggctgaggacgaggctgattattctgccagcttcatacanaacccggcaccatcgtcgttggttttcggnggtacggacaaggctgaccgtcagtcagcccaaggctcgcccctcggtcacttccg

SEQ ID NO: 321663 - DNA, 618 bp, Homo sapiens
  misc_feature: GZ8MTXP02FNK4J.3.87.H10.1.454.CMB.2.raw
  modified_base (241)..(241): a, c, t, g, unknown or other
  misc_feature (241)..(241): n is a, c, g, or t
  modified_base (311)..(311): a, c, t, g, unknown or other
  misc_feature (311)..(311): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctggtctcctggacagtcgtcaccatctcctgcactggaaccagcagtgacagtttggnaatttataactatgtctcctggtaccagcagcacccaggaccaaacgacccccaaactcatgtatttagngagtcaacgaaacgcgccctcgacggggtcctagactcccgtcttcctctcgccctaccgaagtccgtaggaccaaaccgaccggtccctacccgtcgacccgttctcgtcggcctaccgacgccctaggaggattaggaaggtatagttaacttactacgtagacctacgtactactatagtacgacgacgacgtactactaaccgttacgttacggttacgggtacgggtaacggtaaccgacgtacgtaccgtaccgtaaccgtacgtaccgtaccgaccgaccggtacccgtacccgtccccg

SEQ ID NO: 321664 - DNA, 686 bp, Homo sapiens
  misc_feature: GZ8MTXP02JYE4O.3.87.H10.1.454.CMB.2.raw
  modified_base (254)..(254): a, c, t, g, unknown or other
  misc_feature (254)..(254): n is a, c, g, or t
  modified_base (284)..(284): a, c, t, g, unknown or other
  misc_feature (284)..(284): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacaggtcggtcaccatctcctgcactggatccgacggtgacgttgctacttatagtttnctctgtcctgtaccaaaacaccagacaacnccccagattaatgtatttatgatgtcagtgatccggccctcgtaggggtttctctactcgtcttttccgtggtcctccgtaagtcgtcggacaccgccgggtaccctcccgtactaccgtacttcctccgttcggggccttacccgaggtcgtacgggaacggacggaggtccgtagtactttacgtttacgtcggtacgtcgtcgttaccgaagttcgaaccgaaacccgaacccgggacctaaacccgtaccgtttcgggtttaccgggtttcggggttttaccggggtaggggtaaccggggtaaccgtaaacgggtccgttacggtacccgttacggtaacggttaccgaaccggacccgtacggcccgttcccggaccccgttcggtacccttcccg

SEQ ID NO: 321665 - DNA, 706 bp, Homo sapiens
  misc_feature: GZ8MTXP02IY1SL.3.87.H10.1.454.CMB.2.raw
  modified_base (198)..(198): a, c, t, g, unknown or other
  misc_feature (198)..(198): n is a, c, g, or t
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacngtcgtcaccatctctgcatggactccacggtgacgttgctacttatagttnctctgtctgtacaaacnccagcaagccccagataatgatttatgatgtcagtgatccggtccctgtacggggtttctcgtactcgtctttttccgtggtccttccgtaacgttcgtacgggcctaacgcccgggtaccctccccgttaccgaccctactccgttccgtcggggtccttcccgagggccttgggaacgggacggaggtccttaggtaacttttacgtttcttcggaccgtacggtccctttacgtacctaaccgtaaccccgaaaacccgggtcctaaccccgtacgttcgggtttaccggtttcggggtttttaacggggtcggggtaaacgggtacccgtaaacggtccgttaccggtacccgttccgtaaacgggtcccgtaaccggcccgtaaaccgggtccgtccccggtacccccgtccggtaccgtacccttttcccccgg

SEQ ID NO: 321666 - DNA, 750 bp, Homo sapiens
  misc_feature: GZ8MTXP02G5MHT.3.87.H10.1.454.CMB.2.raw
  modified_base (283)..(283): a, c, t, g, unknown or other
  misc_feature (283)..(283): n is a, c, g, or t
  modified_base (314)..(314): a, c, t, g, unknown or other
  misc_feature (314)..(314): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacgaggtcctgggcccagcctgccctgactcagcctgcctccgtgtctgggtctcctggacagtcgtcaccatctcctgcactggactccgacggtgacgttgcttaacttatagtttctcctctggtcctacggtaaccaaaacnccaaggacaacgccccagtataatgatttangtatgtctagtgacgtcgtaccctcggtaggtttcctacgtcttccgttcttttaccgtcggtacttaccgaacgttccgtacggacctaccgtacccgtccctacccgtaccgacctacgttccgtacgtccggtacctcccgacggacgttacgggaacggtacggtacggtacgtttagttaacgtttacgtttccgtacggttaccaaacggttcccttaacctaaaacgttaccccaaacccggtaaaccccgtcccgaaaacccctttcgggttacgtttaccgggggtttacggggttttaccggggacgggttaaacgggaacccgtaaacggtccgttaccggaccccgttcggtaaacggtccgaaccggcccgtaaaacggccccgttaccgacccccggttcgtacccgttccgtttaaccccg

SEQ ID NO: 321667 - DNA, 521 bp, Homo sapiens
  misc_feature: GZ8MTXP02F1ZUX.3.87.H10.1.454.CMB.2.raw
  modified_base (351)..(351): a, c, t, g, unknown or other
  misc_feature (351)..(351): n is a, c, g, or t
  modified_base (457)..(457): a, c, t, g, unknown or other
  misc_feature (457)..(457): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctggtctcctggacagtcggtcaccatctcctgcactggactccaccggtgacgttgcttacttataagtttgtctcctggtcctggtaccaaaaacaccaggcaaacgcccccagattaatgatttatgatgtcagtgatcggccctcagggtttctcatcgctttcngctcaagtctggcacacggccctcctgaccatctctggctccagctgagacgagctgattattctgcagctcactacacaccgcaccactgtcgttggttttcggnggacgggaccaagctacgaccgtctacggtcagcccgaaggcctcgccccctggtccacgttcc

SEQ ID NO: 321668 - DNA, 553 bp, Homo sapiens
  misc_feature: GZ8MTXP02H36T6.3.87.H10.1.454.CMB.2.raw
  modified_base (273)..(273): a, c, t, g, unknown or other
  misc_feature (273)..(273): n is a, c, g, or t
  modified_base (332)..(332): a, c, t, g, unknown or other
  misc_feature (332)..(332): n is a, c, g, or t
  modified_base (383)..(383): a, c, t, g, unknown or other
  misc_feature (383)..(383): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctctggacagtcgtcaccatctcctgcactggatccacggtgacgttgctattataagttgctctgtcctaggtaaccaaaaacnccaaggacaaacgcccagataatgatttatgatgtcagtgatcggctcgtagggtttcnctatcgtctttcgtgtctccaagtctggacacaccggtcctcctgaacctntctcgtcgcctacgacgtcgaggacgacgagtactagtactttattcgtcgtcacnctactanacacacgacactactcgttcgttcggttcggtaggtacggacgacgacgtacgtacgtacgtacgtacgacgaaccgacgacgtccgtcccgtccgtaccgtactcg

SEQ ID NO: 321669 - DNA, 533 bp, Homo sapiens
  misc_feature: GZ8MTXP02F8MTF.3.87.H10.1.454.CMB.2.raw
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
  modified_base (419)..(419): a, c, t, g, unknown or other
  misc_feature (419)..(419): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttanatctctgtctctgtaccaanacaccaggcaaacgcccccaaactcatcatttangatgtcactgctccggccctcgtaggggtttctcatccgtctttcngctcagtctggcacacggcctccgtnaccatccgtcggggctccgaggctgagcgagctgcttatactgnagtctcagtataacgaggacncacactntcgtgtagttggtaggacggtaccaagtcgtcgaccgttacgtaacggtaccgacgcccgtaaacgtccgtaccgccccgttccgg

SEQ ID NO: 321670 - DNA, 647 bp, Homo sapiens
  misc_feature: GZ8MTXP02H6ZLS.3.87.H10.1.454.CMB.2.raw
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccacggtgacgttgctacttatagttgtctctgtctgtacaaacaccagcaagccccagataatgatttatgatgtcagtgatcggccctcgtagggtttctctatcgtcttttcctggtcctacctaagttcgtcggaccaccgtaccgggtccctacccccgtacgacccgtatccgttccgtcggggtcctcccgaggcgtggacggacggagggtaccttggtatttacgtttctgtccgaacgtccttacagtcggaccaaccgaacccgggaccaacccgtacgttcggttccgggttttcgggttttcgggtacggggtacggggtaccgtaaacggtccgtacggtacccgtaccgttacggttcccaacggtccccgaaacgggtccctccggcccccgttcggtaccttcccg

SEQ ID NO: 321671 - DNA, 744 bp, Homo sapiens
  misc_feature: GZ8MTXP02G7A7T.3.87.H10.1.454.CMB.2.raw
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
tcagagacgcactccacgaccggtgctcgatttagcagtactgcgttgggtttggggggtctcaggaggcagcgctctcgggacgtctccaccatggcctgggctctgctattcctcaccctcctcactcagggcacaggtcctgggcccagcctgccctgactcagcctgcctccgtgtctgggtctcctggacagtcgtcaccatctcctgcactggactccgacggtgacgttncttacttatagttntctctgtctgtacaaacnccagcaacgccccagataatgatttatgatgtcagtgatcggccctcgtagggttctcgtactcgttctttccgtcggtccttccgtaacgtccgttacggaccacgtaccggtccctccccgtacgacccgtaactccgttcgtcgggtcccttccgaggtccgtaggaacgggacggacggtaccgttaggttactttaacgtttcgttacgccgtaaacggtcccttactaaaccgttaacccgtaaacccggaaaccccgggtaccctaaaccccgtaacggtttacccggttacggggttttccggggtttttaacgggggacgggggtaaaccgggtaaccccgtaaaggtacccgttaccggtaaaccccggttccgtaaacggttcccgtaaaaccggccccggtaaacggtcccgttaacccccggtcccccgttaccgggtttaccctacccgttttcccccggg

SEQ ID NO: 321672 - DNA, 796 bp, Homo sapiens
  misc_feature: GZ8MTXP02JLN57.3.87.H10.1.454.CMB.2.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (304)..(304): a, c, t, g, unknown or other
  misc_feature (304)..(304): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagagtcctgggcccagtctgccctgactcagcctgcctccgtgtcgtggtctcctggacagtcgatcacatctctgcactaggaaccanagtgtacgttntattttanatctntgtctcgtgtaccaacacaccaggacaaacgacccccaactcatctatttangatgtctacgtcgtacctccggcccttcggtacggggttttccacgtacttccccgttacttttccgacggtccttaccgaagttccgttcgggcccacccgtaccggtccccttacccgtgaaccctcgtccgtcccggggccttacccgaggtcgtacgggaacggaaccgggtacggtaccgttggttacctttaacgtttaaaccgtcgggtacctaacgggtacccttaacgtaaactttaaaacgtaaacccggtaaaacggggtaccgaaccctaacccccgttaaacgtttcccgggtttaacgggtttaccggggtttaaagggtttttacgggggaaacgggggtaacccggggtaaaccgttaaaccgggtaccgtacccgggttaaccccggtaccgggtttaaccgggtaacccggaacccggtacccgggtaaaaccgggttacccgtcccccgggtaaccccccggtttacccgggg

SEQ ID NO: 321673 - DNA, 768 bp, Homo sapiens
  misc_feature: GZ8MTXP02FHNZJ.3.87.H10.1.454.CMB.2.raw
  modified_base (247)..(247): a, c, t, g, unknown or other
  misc_feature (247)..(247): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtaccaacaacaccagacaaacgacccccaaactcatcatttatgtatgtcactgccctccggtcccctcgtacggggtttcctacgtatcccgttccttttcgtggtcctacccaagttccgtcggccaacccgtaccggtcccccttcccgtacgaacccctacgttcccgtcccgggggtcccttacccggaacggtccgtagggaacgggaccggtaacgggccgttaggtacctttaacgttaccgtcggacgtacgtcctacctaaagttacgtaaaccgaaacgggtaccgaccaaccccgtaaccttacccgtttacgggttacgggtttaaacggttttgggggtaacggggtaaacgggggtaaacccgtaaaaccggttccggtaaccggttaacccccggttacccgttaaacgggggtaccccgtaaaacccgggacccccgggtaaaacggggttccccgttaacccccggggtcccccccgtttacccccgggg

SEQ ID NO: 321674 - DNA, 726 bp, Homo sapiens
  misc_feature: GZ8MTXP02GPMJG.3.87.H10.1.454.CMB.2.raw
  modified_base (235)..(235): a, c, t, g, unknown or other
  misc_feature (235)..(235): n is a, c, g, or t
  modified_base (251)..(251): a, c, t, g, unknown or other
  misc_feature (251)..(251): n is a, c, g, or t
tcagagacgcactccacgaccggtgctcgatttagcagtactgcgttgggtttgggaggcctttgttggagaccttgcacttgtactccttgccgttcagccagtcctggtgcacaacggtgaggacgctgaccacacggaacgtgctgttgaactgctcctccgtggctttgtcttggcattatgcacctccacgccgtccacgtaccagttgaactggacctcgggtcttcgngctcacgtccaccacncgcacgtcgacctcaggggtccctcacgactctctgtgcagcctcgtggacttcggctttagcgtacaatcgccagtcggtcgttcggggtccgaccgacggcgtccgaacggggaaggggtcctggggacggttcggggtccgtacgttggggttaacgtttggggtagggtgtagttacgtcggacgtaagaaccgtaacgttaacaaccgtaggttccgtaccggtggggaaccgggggttccccgggtttacaacccgtaacgttaccgtacccgtaaacggtaacgggtaaccctaaaacggtttacccgaaaacggtaaaacccgttaccgggttaaggttaacctaccgttaggaaacccgtaaaagtcggtaacgacggtaccccgtaagacggtaaacggacccgtaacgggaaccgtaccggtaaccttaagttacgttaacgtcgtacgtacgtaaacgtaacg

SEQ ID NO: 321675 - DNA, 302 bp, Homo sapiens
  misc_feature: GZ8MTXP02I32EO.3.87.H10.1.454.CMB.2.raw
  modified_base (191)..(191): a, c, t, g, unknown or other
  misc_feature (191)..(191): n is a, c, g, or t
  modified_base (298)..(302): a, c, t, g, unknown or other
  misc_feature (298)..(302): n is a, c, g, or t
tcagagacgcactccacgaccggtgctcgatttagcagtactgcgttgggtttgggggtgtggtggtctccactcccgccttgacggggctgctatctgcctccctgaccatctctgggctccaggctgaggacgaggctgattatttctgcagctcatacacaaccggcaccactgtcgtggttttcggnggaggaccaagctgaccgtcctaggtcagcccaagctcgcccctggtcactctcgttccccaccctcctcgagtgccgtctctgagcgggctggcaaggcgcatagnnnnn

SEQ ID NO: 321676 - DNA, 686 bp, Homo sapiens
  misc_feature: GZ8MTXP02HCA6D.3.87.H10.1.454.CMB.2.raw
  modified_base (250)..(250): a, c, t, g, unknown or other
  misc_feature (250)..(250): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (390)..(390): a, c, t, g, unknown or other
  misc_feature (390)..(390): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctcgtgtctgggtctccgtggacagtcgatcaccatctcctgccactcggaaaccacagtgacgttgtatttttanatctctgtctctgtacaacacacagacaacnccccaancatctatttatgtatcgtacactcgccgtcccgggtcccttggtacgggtttcctcgtacgttccgttcctttttcgcgtctaccgtaagtccgttcggccncccgaccggtccccctcccgacgtaaccctcgttcccggtccggggtcctacccggacgtccgtaggacggtaacggcggtacttcgtactttagtacctaggctaacgtcttataacgtaacgtaacgaaggtaccacctacctaccgttcgttcgggttaggtttaggtttaccggggaaggggtaccggtaaaccgtaaacggtccgttaccgttacccgttacggttaccggccgtaaccgacccccggtaacggtccccgtacccggtccccccggttacggttacccccg

SEQ ID NO: 321677 - DNA, 605 bp, Homo sapiens
  misc_feature: GZ8MTXP02H0N39.3.87.H10.1.454.CMB.2.raw
  modified_base (345)..(345): a, c, t, g, unknown or other
  misc_feature (345)..(345): n is a, c, g, or t
  modified_base (430)..(430): a, c, t, g, unknown or other
  misc_feature (430)..(430): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctctggtcctgtaccaaaacaccagcaagccccagataatgatttatgatgtcagtgatcggccctcgaggggttctcatcgtcttttcnggtctccagtctggcacgacgccctccctcgaccagtctcgtgggtctccgaggccgtagagggacgaggctgtatttactttcngtccgtagccttacgactaccgacgaaacccggcaaccacgttcggttcggtttcggggttttcgggagggtaacgggacccaaaggtccgttcggaaacccgttccgtacggttaccaaccggtaacccgaacgggtcctcccggcccccgttcgggttacctaccgtttcccg

SEQ ID NO: 321678 - DNA, 621 bp, Homo sapiens
  misc_feature: GZ8MTXP02I84P8.3.87.H10.1.454.CMB.2.raw
  modified_base (229)..(229): a, c, t, g, unknown or other
  misc_feature (229)..(229): n is a, c, g, or t
  modified_base (247)..(247): a, c, t, g, unknown or other
  misc_feature (247)..(247): n is a, c, g, or t
  modified_base (299)..(299): a, c, t, g, unknown or other
  misc_feature (299)..(299): n is a, c, g, or t
  modified_base (331)..(331): a, c, t, g, unknown or other
  misc_feature (331)..(331): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctctgcactggaaaccanagtgacgttgtattttanatctctgtctctgtaccaacacaccagacaacgaccccaactcatcatttangatgcactcgcctccgcctcgtacgggtttcnctactccgttctttcgcggcttaccgaagttctcggaccaccgaccgtccctccctacgacctacgtccgtccgggcctcgacggcgtagacggtacgaggtctgtacttagttactacgctacgtctactattaacgtaacgaacggacaccgtaaacctaccgttcgttacggtacgggtttacgtttagggggacggaacggggtaaacccaaggtaccgtacgtacccggttaccggtaacggtactacggacccgaacggtccgtcccggtaccccgttacccgg

SEQ ID NO: 321679 - DNA, 611 bp, Homo sapiens
  misc_feature: GZ8MTXP02FNVMU.3.87.H10.1.454.CMB.2.raw
  modified_base (374)..(374): a, c, t, g, unknown or other
  misc_feature (374)..(374): n is a, c, g, or t
  modified_base (408)..(408): a, c, t, g, unknown or other
  misc_feature (408)..(408): n is a, c, g, or t
tcagagacgcactccacgaccggtgctcgatttagcagtactgcgttgggtttgggaggcctttgttggagaccttgcacttgtactccttgccgttcagccagtcctggtgcacaacggtgaggacgctgaccacacggaacgtgctgttgaactgctcctcccgtggctttgtcttggcattatgcacctccacgccgtccacgtaccagttgaactggacctcggggtcttcgtggctcacgtccaccaccacgcacgtgacctcgacggggtccctcagactctcctgtcgcacgcctctggattcggctttagcgacaatgccagtggcttgggtcccgcaggcctcgagggagggctggagtgggtcncgtgggtatgggtggtgagtagtcgcagcactanacagtctccggtgacgggggtccgttacaccattccaccgagaacgaactaaacttaccgaaaagtaaccgacggtagttaactcttaggaacctaaaagtcggaacgtaacgcccgtaggaaacggacggaccgggtaacgaccgaaccgggtaacccttaaaggttttacttacgtggttaccggaacgtaaaaggttaag

SEQ ID NO: 321680 - DNA, 644 bp, Homo sapiens
  misc_feature: GZ8MTXP02FU1R2.3.87.H10.1.454.CMB.2.raw
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
  modified_base (311)..(312): a, c, t, g, unknown or other
  misc_feature (311)..(312): n is a, c, g, or t
  modified_base (346)..(346): a, c, t, g, unknown or other
  misc_feature (346)..(346): n is a, c, g, or t
  modified_base (423)..(423): a, c, t, g, unknown or other
  misc_feature (423)..(423): n is a, c, g, or t
tcagagacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggactccaccggtgacgttgcttacttatagtttgtctcctggtcctaggtaaccaaaacnccgaggacaaccgcccagtatatntattannatgatagtgacgtccgtcccgtaggttcggttcncgtattcgttctttccgcgtcctacgtacgtcgtacgactaccgccgtccctaccgtacacgtactcgtcgcgtccncgtagtcaggacgacgtagtgttacgttatttacgtctgactacacctacaaacgtaccaaaccgtacccgactacgtacgttacggttccggttagggtttaccggacgggtaaaccgacgtaaacgtaccgtaccggtaacgtttaccggtacgtcgaacccgtaaccggaaaccggtccctaccccggttccccgtacgttaccgtaccgtttcccgg

SEQ ID NO: 321681 - DNA, 606 bp, Homo sapiens
  misc_feature: GZ8MTXP02JCUV5.3.87.H10.1.454.CMB.2.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (309)..(310): a, c, t, g, unknown or other
  misc_feature (309)..(310): n is a, c, g, or t
  modified_base (313)..(313): a, c, t, g, unknown or other
  misc_feature (313)..(313): n is a, c, g, or t
  modified_base (334)..(334): a, c, t, g, unknown or other
  misc_feature (334)..(334): n is a, c, g, or t
  modified_base (455)..(455): a, c, t, g, unknown or other
  misc_feature (455)..(455): n is a, c, g, or t
tcagagacgcactccacgaccggtgctcgatttagcagtactgcgttggggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacngtcggtcaccatctcctgcactggatccgacggtgacgttncttattatagttnctctggtcctgtaaccaaacaccaggacaaacgcccagattaangatttangatnnagngatcgaccctgtagggtttcnctactcgttctttccgcggtcctacgacgtttcacggtacacgtaccggcccttccgtacactactccgtagtccggcttacccgagcgtggaacggtacgaggtactgtattacgtttcngacatctacactaccgaccgaacgtcctacgtgtcggttcggttacgggttcggacggtacgtaacgtacgtcgttaccggtacgtaccgtacggacccacgaacccggtacggtcccgtacccgcccggttaccgtcctaccgtttcccg

SEQ ID NO: 321682 - DNA, 651 bp, Homo sapiens
  misc_feature: GZ8MTXP02IU7LV.3.87.H10.1.454.CMB.2.raw
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
  modified_base (295)..(295): a, c, t, g, unknown or other
  misc_feature (295)..(295): n is a, c, g, or t
  modified_base (302)..(303): a, c, t, g, unknown or other
  misc_feature (302)..(303): n is a, c, g, or t
tcagagacgcactccacgaccggtgctcgatttagcagtactgcgttggggtttgggggggtctcaggaggcagcgctctcgggacgtctccaccatggcctgggctctgctattcctcacccctcctcactcagggcacagggtcctgggcccagcctgccctgactcagcctgcctcgtgtctggtctcctggacngtcggtcaccatctcctgcactggactccgacggtnacgttgctacttataagtttgtctctgtctgtaaccaaaacaccagcaagccccagataangatttannatgtcagtgatccgccctgtagggtttctctactcgtctttctcggtctccgaagttctcggccaccgtaccggtcccctcccgtcgtaccctagttccggcggggtcctccgaggtcctaggacgggtaaccgagggtccttaggtcttttaacgtacgttacgacgtaacggtccttacgtaattaacgttaaccgaaacgggaccaccgtaccctaaccttcgttaccggtttagggtttaagtttcgggggttacgggaaacggggtaccctaaaaggtccgtacggtaccccgttacgtacggtacaacgtcccgaacgtccctcgcccccgtgtaccctacc

SEQ ID NO: 321683 - DNA, 621 bp, Homo sapiens
  misc_feature: GZ8MTXP02FQ5SM.3.87.H10.1.454.CMB.2.raw
  modified_base (322)..(322): a, c, t, g, unknown or other
  misc_feature (322)..(322): n is a, c, g, or t
  modified_base (370)..(370): a, c, t, g, unknown or other
  misc_feature (370)..(370): n is a, c, g, or t
  modified_base (611)..(611): a, c, t, g, unknown or other
  misc_feature (611)..(611): n is a, c, g, or t
tcagagacgcactccacgaccggtgctcgatttagcagtactgcgttgggtttggggggggtctcaggaggcagcgctctcgggacgtctccaccatggcctgggctctgctattcctcaccctcctcactcaggcacagggtcctgggcccagcctgccctgactcagcctgcctccgtgtctgggtctcctggacagtcggtcaccatctcctgccatcggactccgaccggtgtacgttgcttacttattaagtttcgtactctggtcctacggtaaccaaaacacccaggacaacgccccaagacttaatgtatttangtatgtcagtgtacgtcgtccctgtacggtttctctatcgtctttccngtcctacgtagtctcggacaccgtaccgccctcgtacgacctactccgtcgtggcctaccgcgctaggaggtacgacggtctagttattacttcgtagcgtacgtctacgaactacgtaaccgaccgacctaccgtaacggttcgtcggtttacgggtttcggacgggtaacggaccgtacgtccggtacgtaccgtcgtacggtcgtaccgaaccgtacggctcccgtacccgtcggtcnccgtttcccg

SEQ ID NO: 321684 - DNA, 563 bp, Homo sapiens
  misc_feature: GZ8MTXP01D4CU4.10.68.G02.1.454.CMB.2.raw
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (368)..(368): a, c, t, g, unknown or other
  misc_feature (368)..(368): n is a, c, g, or t
tcagcatagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgaccaaacaaaatatgctttagtggtaacgagacaaaagccaggccaggcccctgtcttgttgatatatgagacacagcgaccgtcgaattcngagngattcncgctccaagctcgagggacagtcgccttcttgactntcgaggtcggggccgaggggtcgagtgaggctgactactacgttcgtttcgtcgtacttcgtacttcgacgttggttaaacggttggtacgttcggttcgggacgggtaacgggaacctaaggccgtcggaccgtccgtacgccggttcacgcccgaaggtccgtccgcccccgttcggtaaccttccgttcccg

SEQ ID NO: 321685 - DNA, 546 bp, Homo sapiens
  misc_feature: GZ8MTXP01C3VZL.10.68.G02.1.454.CMB.2.raw
  modified_base (242)..(242): a, c, t, g, unknown or other
  misc_feature (242)..(242): n is a, c, g, or t
  modified_base (525)..(525): a, c, t, g, unknown or other
  misc_feature (525)..(525): n is a, c, g, or t
  modified_base (538)..(538): a, c, t, g, unknown or other
  misc_feature (538)..(538): n is a, c, g, or t
tcagcatagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccacctcggtgtcagtgtccccaggacagactgccaggatcagctgctctggagatgcattgaccaaacaaaatntgcttattggtacgagacaaacgcacgcacggcccctgtcttgtgatatatgagaccaacaagcccgacccgtacggtaatttcgtagagtacgtacttcgtccggctaccgaagtcctcgagggactaggtcggtaccttccgtagactattcgagggtcgggaccggtaggggtcgagtggagcgtagactactacgttgttcgtcgtactgtacttctacgtaggtaacgtgtctggtcggcggagaacagcgtcgacgtcgtgcgttcgacgccgagcnccgcccttgtccncgttcccg

SEQ ID NO: 321686 - DNA, 581 bp, Homo sapiens
  misc_feature: GZ8MTXP01CD0E8.10.68.G02.1.454.CMB.2.raw
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
tcagcatagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtcgtccccaggacagactgccaggatcagctgctctggagatgcattgaccaaanaaaatntgcttatggtacgagacaaaagccaggccacggcccctgtcttgtgatatatgaagacaccgaagccgaccctacggtaatttcgtgagtacgattcgtccggctccgaagcctcgagggacaggtcggccctcttgactatcgaggtcggggcccgagggggtcgagtggaggctagactactactgtttcgcgtactgtacttcagttacggtaacgttggcgttgggttccgggcgggtacgggaaccgaaggttcgtacggaccgtccgtggccgttcgaccggtaacccgacggtccttcccggcccccgttcggtccttaaccgttccccg

SEQ ID NO: 321687 - DNA, 521 bp, Homo sapiens
  misc_feature: GZ8MTXP01ASYSF.10.68.G02.1.454.CMB.2.raw
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
  modified_base (320)..(320): a, c, t, g, unknown or other
  misc_feature (320)..(320): n is a, c, g, or t
  modified_base (388)..(388): a, c, t, g, unknown or other
  misc_feature (388)..(388): n is a, c, g, or t
  modified_base (420)..(420): a, c, t, g, unknown or other
  misc_feature (420)..(420): n is a, c, g, or t
  modified_base (460)..(460): a, c, t, g, unknown or other
  misc_feature (460)..(460): n is a, c, g, or t
  modified_base (515)..(515): a, c, t, g, unknown or other
  misc_feature (515)..(515): n is a, c, g, or t
tcagcatagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgcaacaaatntgcttatggtacgancaaaagccaggccaggcccctgtcttgttgatatatgagacaccaagccgaccctcggaaatttcngagacgattctccggctcccaagcctcgagggaccagtcgccttcttgactatcaggtcggggcccgnggggtcgagtgaggctgactactacttgttcncgactgacttcacgtggtaaaccgtggtctgttcggcggngggaaccaagctcgaccgtcctgccgttcacgcccaggctcgccccgttggtccncgttcc

SEQ ID NO: 321688 - DNA, 703 bp, Homo sapiens
  misc_feature: GZ8MTXP01DWKMU.10.68.G02.1.454.CMB.2.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
tcagcatagtagtgcacgaccggtgctcgattagtcgatagtgaagggaaaggggggtgtgggctcaggaggcagagctctgggaatctcaccatggcctggacccctctcctgcctccccctcctcactttctgcacagtctctgaggcctcgtatgaactgacacagccaccctcggtgtcagtcgtccccaggacagactgccaggatcagctgctcgtgganatgcattcgaccaaataaaatntgtacttagtaggtaacgagaacaaaacgccgaaggcccacggccccttgtctttgtagaattatagtaggaacgaccaaccgaagcccgtacccgtacggtaactttcgagacgtacgtactttcgccggctccgaaagctaacggacggtacgtggtaccggtccttccgtagtaaccttacgtcgtacggggtccgggggacccgtaaggggggttccgaagtagggacggtacgtacggtaaaccttaccttaacgtttcgtttaccgtacgtaacgttcgttaaccttaccgtaacggttaacgggttaaaccggttgggtccgttcggggttaccgggacgggaacggtaacccgaacgttccgtacggttaacccgttcgcggttaccgacgacccggcccgaacggtcccgtccccggcccccgttcggtcccttaacctttccccg

SEQ ID NO: 321689 - DNA, 682 bp, Homo sapiens
  misc_feature: GZ8MTXP01CC9W2.10.68.G02.1.454.CMB.2.raw
  modified_base (392)..(392): a, c, t, g, unknown or other
  misc_feature (392)..(392): n is a, c, g, or t
tcagcatagtagtgcacgaccggtgctcgattagtcgatagtgaagggaaaggggggtgtgggctcaggaggcagagctctgggaatttcaccatggcctggacccctctcctgcctccccctcctcacttttctgcacagtctctgaggcctcgtatgaactgacacagcccaccctcggtgtcaggtcgtccccaggacagactgccaggatcagctgctcgtggagatgcattacgaccaaataaaattatagtcttaagttggtaacgaagacgaaaagccaaggcccacggcccctgtcttgtgaatatagtggaacgacaaccgaacgacctacccgtacggtaatttcgaggagtagtaccttccgtcggctcccagcctaccgngggacagggtcgtaccttccgttacgactacgtcgtacggggtaccggggacccgggtagggggttacgacggtaggaacgggtctacggtaaccttacgttacgttgtttcctacggggtacttacgtacctttacgtaacgttacggttaaacggtttggtacgttcgggttcgggacgggtaacgggaccgtaaaggtccgttacggtacccgttcgtacggtcgttccgacgacccgaagggccctcccggtccccgttcggttccctaaccgttcccgttccccg

SEQ ID NO: 321690 - DNA, 578 bp, Homo sapiens
  misc_feature: GZ8MTXP01BOCT3.10.68.G02.1.454.CMB.2.raw
  modified_base (245)..(245): a, c, t, g, unknown or other
  misc_feature (245)..(245): n is a, c, g, or t
  modified_base (288)..(288): a, c, t, g, unknown or other
  misc_feature (288)..(288): n is a, c, g, or t
  modified_base (318)..(318): a, c, t, g, unknown or other
  misc_feature (318)..(318): n is a, c, g, or t
tcagcatagtagtgcacgaccggtgctcgattagtcgatagtgaagggaaaggggggtgtgggctcaggaggcagagctctgggaatctcaccatggcctggacccctctcctgcctccccctcctcactttctgcacagtctctgaggcctcgtatgaactgacacagccaccctcggtgtcagtgtccccaggacagactgccaggatcagctgctctggagatgcattgaccaaacaaaatntgcttatggtacgagacaaaagccagccaggcccctgtctgtnatatatgagacacaagcgacctcgaattcngagacattcgccgctccaagctcgagggacagtcggccttctagactagtcgaggtcgggccgagggggtcagtgagctgactatacttgtttcgtacgtacttcgacttcgaacgttacgggttaaacgttgggtacttggggttaccgggacgggacggggaaacccaaggttccgtacgttacccggttccgtggccgttccgacggccccgaacggtccctcccggtcccccgttcgggtcccttaaccttccccg

SEQ ID NO: 321691 - DNA, 566 bp, Homo sapiens
  misc_feature: GZ8MTXP01DNB4Z.10.68.G02.1.454.CMB.2.raw
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
  modified_base (376)..(376): a, c, t, g, unknown or other
  misc_feature (376)..(376): n is a, c, g, or t
  modified_base (393)..(393): a, c, t, g, unknown or other
  misc_feature (393)..(393): n is a, c, g, or t
  modified_base (557)..(557): a, c, t, g, unknown or other
  misc_feature (557)..(557): n is a, c, g, or t
tcagcatagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtcgtccccaggacagactgccaggatcagctgctcgtgganatgctattgaccaaacaaaatntgcttattaggtacgagacaaaagccaggccacggtcccctgtcttgtgatatatgaggacacagcgacctcggaatttcngagcgattcnccggctccaagctcgagggacagtcggcctcgttgactntcgaggtcggggaccgnggggtcagtgagctagactactacgttgtttcgtacgtacttcgtacttcgtaacgttaggttaaacggttggtccgttgggttcgggcgggtagggaaccaaggttcgtcggaccgtcgtcgccgttcgacggcccgaaggtcctcccgccccgttcggtccncgtttcccg

SEQ ID NO: 321692 - DNA, 655 bp, Homo sapiens
  misc_feature: GZ8MTXP01ACKOH.10.68.G02.1.454.CMB.2.raw
  modified_base (248)..(248): a, c, t, g, unknown or other
  misc_feature (248)..(248): n is a, c, g, or t
  modified_base (645)..(645): a, c, t, g, unknown or other
  misc_feature (645)..(645): n is a, c, g, or t
tcagcatagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagcccaccctcggtgtcagtcgtccccaggacagactgccaggatcagctgctcgtggagatgctattcgaccaaactaaatntgtctttaagttggtaacgagaacaaacgccgaggccacggtcccctgtcttgtgatatatggagaccacaagcccgtacccgtcggtaatttcgagacgagtacttccgtaccggctccgaaagctcggaagggtacctaggttccggccttcgtagacctagtcgagggtccgggggacccgaagggggtcctaagtcggacgggtcttaggaaccttacgttacgttcgtttacgtacgacgtttacgtaaccttcgaaccgttgggttaaacgtttcgggcttaggggttaccgggacgggtaagggtaaccccaaggttccgtacgggacccgttcgtcggaccgttcgaacggtccccgaggtccctacccggtccccgttggttaacccncgtttccccg

SEQ ID NO: 321693 - DNA, 563 bp, Homo sapiens
  misc_feature: GZ8MTXP02I8V0J.10.68.G02.1.454.CMB.2.raw
  modified_base (246)..(246): a, c, t, g, unknown or other
  misc_feature (246)..(246): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
tcagcatagtagtgcacgaccggtgctcgattagtcgatagtgaagggaaagggggtgtgggctcaggaggcagagctctgggaatctcaccatggcctggacccctctcctgcctccccctcctcactttctacacagtctctgaggcctcgtatgaactgacacagccaccctcggtgtcagtcgtccccaggacagactgccaggatcagctgctctggagatgcattgacccaaacaaaatntgtcttattggtacgagacaaaagccaggccacggcccctgtcttgttgatatatgagacacagccacctcgaattcngaganacttcnccgctccagctcgagggacaggtcgcccttccttgactatcgaggtcggggcccgaggggtcgagtggacggctgacttactacttgtttctcgacttgtaccttcgacgttaggtaaacgttggtcgttggttcgggcgggtacgggaccaacggcgtacgacccgtctcgccgtcgaccgacccgaaggtcctccggtcccccgtcggtccacgttccgtttcccg

SEQ ID NO: 321694 - DNA, 550 bp, Homo sapiens
  misc_feature: GZ8MTXP02IWBGF.10.68.G02.1.454.CMB.2.raw
  modified_base (222)..(222): a, c, t, g, unknown or other
  misc_feature (222)..(222): n is a, c, g, or t
  modified_base (243)..(243): a, c, t, g, unknown or other
  misc_feature (243)..(243): n is a, c, g, or t
  modified_base (322)..(322): a, c, t, g, unknown or other
  misc_feature (322)..(322): n is a, c, g, or t
tcagcatagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctgganatgcattgaccaaacaaaatntgctttatggtacgagacaaaagccaggccaggcccctgtcttgtgatatatgagacaccagcgaccctcggaatttcngagacgattcgtccgctcagctcgaggacaggtcgccctcgttgactatcgtaggtcggggcccgagggggtcgagtggaggctagactactacgttgtttcgtcgtactgtactttcgaacgttcggttaaacgttggacgttgttcgggacggaggaccgtaaggcgtacgaccgtcgtcgacgtcgacgccgacggctcccggccccgtcgtcccaccgttcccg

SEQ ID NO: 321695 - DNA, 577 bp, Homo sapiens
  misc_feature: GZ8MTXP02F8UR0.10.68.G02.1.454.CMB.2.raw
tcagcatagtagtgcacgaccggtgctcgattagtcgatagtgaagggaaagggggtgtgggctcaggaggcagagctctgggaatctcaccatggcctggacccctctcctgcctccccctcctcactttctgcacagtctctgaggcctcgtatgaactgacacagccaccctcggtgtcagtcgtccccaggacagactgccaggatcagctgctctggagatgctattgaccaaactaaaatatgtctttagttggtaacgagacaaaacgcccaaggcccacggcccctgtctttgtgatatatgagacacagccgaccctcggtaattcgtagagacgtacttccgtccgctccgagcctcggacgggactaggtcgcccttacgttgactagtcgaggtcggggacccgagggggtcagtggagctgactctacgttcgtttctcgtatcgtacttcgacgttaggttaaacgttggtcgttggtcgggacggaacgggaccaaggccgtcgaccgttcgtcgcgtcgacgaacccgacggcctccgcccccgtcggtcctaccttcccg

SEQ ID NO: 321696 - DNA, 728 bp, Homo sapiens
  misc_feature: GZ8MTXP02GKSLA.10.68.G02.1.454.CMB.2.raw
  modified_base (250)..(250): a, c, t, g, unknown or other
  misc_feature (250)..(250): n is a, c, g, or t
tcagcatagtagtgcacgaccggtgctcgattagtcgatagtgaagggaaagggggtgtgggctcaggaggcagagctctgggaatctcaccatggcctggacccctctcctgcctccccctcctcactttctgcacagtctctgaggcctcgtatgaactgacacagccaccctcggtgtcagtcgtccccaggacagactgccaggatcagctgctcgtggagatgactattcgaccaaactaaaatntgtactttaagtcggtaacaagaacaaaacggcccgaacggcccaaccggtccccttgttccgtttgttagaattatagtacggaacggaccaaaccgtaacggaccccgtaaccccgttaccggtaaattttccgaggtaacgtaacgttacttcccgtacccggtccttacccgaagtcctacggacggggtactagggtccgtcccttacgtttagacttacgtcgtacggggttaccgggggacccggtagggggttccaggtcggtacggtacgtacgtaaccgtttacgttaacgtttcgtttaccgtaccgtacgttacgttaccttacgtaaccgttagggttaaacgttcggtacgttcggtaccggggacgggtaacgaaccgacggtccgtaccggacccgttcgacggtccgacgaccgaacccgaacggtcccgtacccgcccccttcggtaccctccttccccg

SEQ ID NO: 321697 - DNA, 608 bp, Homo sapiens
  misc_feature: GZ8MTXP02J26HP.10.68.G02.1.454.CMB.2.raw
  modified_base (248)..(248): a, c, t, g, unknown or other
  misc_feature (248)..(248): n is a, c, g, or t
  modified_base (367)..(367): a, c, t, g, unknown or other
  misc_feature (367)..(367): n is a, c, g, or t
  modified_base (542)..(542): a, c, t, g, unknown or other
  misc_feature (542)..(542): n is a, c, g, or t
tcagcatagtagtgcacgaccggtgctcgattagtcgatagtgaagggaaagggggtgtgggctcaggaggcagagctctgggaatctcaccatggcctggacccctctcctgcctccccctcctcactttctgcacagtctctgaggcctcgtatgaactgacacagccaccctcggtgtcagtcgtccccaggacagactgccaggatcagctgctctggagatgctattcgaaccaaacaaaatntgtacttaagttggaacgagacaaaagccaggccacggcccctgtcttgtgatatatgagacaccaagccgaaccctcggtaaatttcgagtagctacttcctcccggactccgagtcncggacggggaactaggtcggtcccttccgttagactacgtcgagggtccgggggccgtagggggtcgagtggacggtctagtacttacttacttcgtttccgtcgacttgtaccttcgtacgttagggttaaacggtcggtcgttcggttacgggacgggacggaaccgaggccnccggtaccgtccgtcgccgtaccgaacgtcccgaacgccgccgtcccccgcgtaccctacttcccg

SEQ ID NO: 321698 - DNA, 788 bp, Homo sapiens
  misc_feature: GZ8MTXP02JSFH2.10.68.G02.1.454.CMB.2.raw
tcagcatagtagtgcacgaccggtgctcgattagtcgatagtgaagggaaaggggggtgtgggctcaggaggcagagctctgggaatctcaccatggcctggacccctctcctgcctccccctcctcactttctgcacagtctctgacggcctcgtatgaactgacacagcccaccctcggtgtcagtcgtccccaggacagactgccaggatcagctgctctggagatgctattcgaacccaaactaaaattatgtacttagttaggtaacgaagaacgaaaacgccgaacggacccaccggtccccttgttcctttagttagtattaatagtaggaacggaaccaaccgaaacggtcccgtaaccccgtacggtaaactttccgaggtaacgtacgtacgttccgtccgggcctaccgacgtcctacggaacggggtactacgggttccgtccctttccgttacgaacgttacgtaccggtacggggtacccgggggacccgggtacggggggtacgtaggtacgggacggtacgtacggtaaccgttaaccgttaccgtttacggtttaccgtacggttaccgttacgttaaccgtttaccgtaaccggtttaaggggttaaaccggtttcgggtaccggttcggggttaccggggtacggggtaaaccgggtaccgaacggtccggtaaccggtacccgtaccggtcggaccgtacccgaaccggtcccgaaaccggtcccgtaccccggtacccccgtccgggttaccctacccgtttccccg

SEQ ID NO: 321699 - DNA, 565 bp, Homo sapiens
  misc_feature: GZ8MTXP02FWZXO.10.68.G02.1.454.CMB.2.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (384)..(384): a, c, t, g, unknown or other
  misc_feature (384)..(384): n is a, c, g, or t
tcagcatagtagtgcacgaccggtgctcgattagtcgatagtgaagggaaagggggtgtgggctcaggaggcagagctctgggaatctcaccatggcctggaccccctctcctgcctccccctcctcactttctgcacagtctctgaggcctcgtatgaactgacacagccaccctggtgtcagtcgtccccaggacagactgccaggatcagctgctcgtggagatgctattgaccaaanaaatntgtcttagtggtacagacaaagccaggccacggccctgtcttgtgatatatgagacacagccgacctcgatcngagatactcncgctcanctcgaggacagtcgcctctagactntcgnggtcggggccgagggggtnacgtgacgtcgtgtaacgtactactttcgttctccgtattcgtaaccttcgaacgttacggttaaacggttggtacgttggggttccggacgggtaacgggaacgaacggtcgtcgaccgttcctcggccgtcaccgaaccgaacgtcctacccggccccgtcggtaccctcgtttccccg

SEQ ID NO: 321700 - DNA, 523 bp, Homo sapiens
  misc_feature: GZ8MTXP02JDJT9.10.68.G02.1.454.CMB.2.raw
  modified_base (243)..(243): a, c, t, g, unknown or other
  misc_feature (243)..(243): n is a, c, g, or t
  modified_base (324)..(324): a, c, t, g, unknown or other
  misc_feature (324)..(324): n is a, c, g, or t
  modified_base (466)..(466): a, c, t, g, unknown or other
  misc_feature (466)..(466): n is a, c, g, or t
  modified_base (503)..(503): a, c, t, g, unknown or other
  misc_feature (503)..(503): n is a, c, g, or t
  modified_base (517)..(517): a, c, t, g, unknown or other
  misc_feature (517)..(517): n is a, c, g, or t
tcagcatagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgaccaaacaaaatntgcttattggtacagacaaaagccaggccaggcccctgtcttgtgatatatgaggacacaagccgaccctccggaatttcngagagtattctccggctccagctcgagggacagtcgcctcttgactatcgaggtcggggcccgagggggtcgatgaggctagactactacttgtttactcgtactgtacttcacgttaggtaaacggttggactgttcgggnggtaggaccaagctcgaccgtctgcgtcagccgagcncgccccgtacgtcncttccg

SEQ ID NO: 321701 - DNA, 661 bp, Homo sapiens
  misc_feature: GZ8MTXP02IY0G5.10.68.G02.1.454.CMB.2.raw
tcagcatagtagtgcacgaccggtgctcgattagtcgatagtgaagggaaaggggggtgtgggctcaggaggcagagctctgggaatctcaccatggcctggacccctctcctgcctccccctcctcactttctgcacagtctctgaggcctcgtatgaactgacacagccaccctcggtgtcagtgtccccaggacagactgccaggatcagctgctcgtggagatgctattcgaccaaacaaatatgtacttagttaggaacgagaacaaacgccgaggccacggtcccctgtcttgtgatatatgagacacaacgccgaccgtacgtatttcgagagacgtacttccgtccgctccgacgtctcggacggactacggtccgtcccttacgttgaccgttagtccggtacggggtcccgggggaccgggtagggggtccgaaggtcggacggtacgtacggtaccttacgttaccgtttcgtttaccgtaccggttacttacggttaccttaccgtaaccgtttacgggttaaacggttcggtcggttacgggttacgggacgggacggaccgtacggccgtccggaccgttcgacgtaccgtaccgaccggaacccgacggcccgtccccggaccccgttcggtcctaccgttccccg

SEQ ID NO: 321702 - DNA, 484 bp, Homo sapiens
  misc_feature: GZ8MTXP01EKIBD.17.11.A11.1.454.CMB.2.raw
  modified_base (358)..(358): a, c, t, g, unknown or other
  misc_feature (358)..(358): n is a, c, g, or t
  modified_base (470)..(470): a, c, t, g, unknown or other
  misc_feature (470)..(470): n is a, c, g, or t
  modified_base (474)..(484): a, c, t, g, unknown or other
  misc_feature (474)..(484): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaggcgcctaatttataaggtttctaaccgggactctggggtcccagacagattcagcggcagtggtcaggcactgatttcacactgagaaatcagcagggtgaggctgaggatgttggggtttatactgcttgcaaaggtacacactgggtacncttttggcccagggggaccaaagctgggagatcaaacgaactgtggctgcaccatctgtcttcatcttcccgcatctgactagtctacgctgagcgggctggcaaggccganatgnnnnnnnnnnn

SEQ ID NO: 321703 - DNA, 619 bp, Homo sapiens
  misc_feature: GZ8MTXP01AZKKB.17.11.A11.1.454.CMB.2.raw
  modified_base (209)..(209): a, c, t, g, unknown or other
  misc_feature (209)..(209): n is a, c, g, or t
  modified_base (609)..(619): a, c, t, g, unknown or other
  misc_feature (609)..(619): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaggcnccttaatttataaggtttctaaccgggactcgtggggtcccagacagattcagcggcaggtggtcaggcactgatttcacactgagaatcagcgaggggtggaggctaggaggtagttgggttttagggggtttaattacgtggtctttgacgtaaaggtaccacgtacgttagggttacctcgttttcgggacccgtaagggggacccaaggtcgtagggaacgtattaacgaaaacggtacgtggtcggtctacggaccacctacttcgtcgttccttactacttccgtttccccgcctaacttccttacgtaaccgttaacgttccgttaaccggcgttacgggacgggtccggggtccggtcgggacggaaacggggtcccgacgtaaaggtgcgnnnnnnnnnnn

SEQ ID NO: 321704 - DNA, 391 bp, Homo sapiens
  misc_feature: GZ8MTXP01B4OI7.17.11.A11.1.454.CMB.2.raw
  modified_base (388)..(391): a, c, t, g, unknown or other
  misc_feature (388)..(391): n is a, c, g, or t
tcagcgtagactagcacgaccggtgctcgatttagctacgactgcaggtctagtgaaagcctcgtagacagtgatggaaacacctacttgaattggtttcaacagaggccaggccaatctccaaggcgcctaatttataaggtttctaacctggactctggggtcccagacagattcagcggcagtgggtcaggcactgatttcacactgagaatcagcagggtgagctgaggatgttgggttattactgcttgcaaggtacacactggtacactttggccagggaccaagctggagatcaaacgactgtggctgcaccatctgtcttcatccttcccccgctatctgactaagtctaacgctgacgcgggctggcaaggcgcatagnnnn

SEQ ID NO: 321705 - DNA, 487 bp, Homo sapiens
  misc_feature: GZ8MTXP01AQK7X.17.11.A11.1.454.CMB.2.raw
  modified_base (366)..(366): a, c, t, g, unknown or other
  misc_feature (366)..(366): n is a, c, g, or t
  modified_base (458)..(458): a, c, t, g, unknown or other
  misc_feature (458)..(458): n is a, c, g, or t
  modified_base (467)..(467): a, c, t, g, unknown or other
  misc_feature (467)..(467): n is a, c, g, or t
  modified_base (477)..(477): a, c, t, g, unknown or other
  misc_feature (477)..(477): n is a, c, g, or t
  modified_base (483)..(487): a, c, t, g, unknown or other
  misc_feature (483)..(487): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggttcaacagagccaggccaatctccaaggcgcctaatttataaggtttctaaccgggactcgtggggtcccagacagattcagcggcagtgggtcaggcactgatttcacactgagaatcagcgagggtggaggctgaggagttggttgggggtttattactgcttcgacaaggtacacactagggtacncgttttgggccgaggggtaccagctggagatacaaacgactagtggctggacaccatctagtcttcactcttccgcatctgctagtctacgntgagcggtnggacaggccngatagnnnnn

SEQ ID NO: 321706 - DNA, 516 bp, Homo sapiens
  misc_feature: GZ8MTXP01EHKY5.17.11.A11.1.454.CMB.2.raw
  modified_base (485)..(485): a, c, t, g, unknown or other
  misc_feature (485)..(485): n is a, c, g, or t
  modified_base (504)..(504): a, c, t, g, unknown or other
  misc_feature (504)..(504): n is a, c, g, or t
  modified_base (506)..(516): a, c, t, g, unknown or other
  misc_feature (506)..(516): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacactacttgaattggtttcaacagaggccaggtccaatctccaaggcgcttaatttataaggtttctaaccgggactctggggtcccagacagattcagcggcaggtggtcaggcactgatttcacactgagaaatcagcgagggtgagctgaggtattggttgggtttattacgtgtcttgactaaggtacactacgtaggtactaacgtttcggacccgtagggggaccaaggcgtagggacgagtacaaacgtactgtggctgacacatctgtacttcacttccttcccgctatctgtactcgttcacgtctggacgcggntggacagggccgagagtgngnnnnnnnnnnn

SEQ ID NO: 321707 - DNA, 654 bp, Homo sapiens
  misc_feature: GZ8MTXP01BSKN1.17.11.A11.1.454.CMB.2.raw
  modified_base (640)..(640): a, c, t, g, unknown or other
  misc_feature (640)..(640): n is a, c, g, or t
  modified_base (642)..(642): a, c, t, g, unknown or other
  misc_feature (642)..(642): n is a, c, g, or t
  modified_base (644)..(645): a, c, t, g, unknown or other
  misc_feature (644)..(645): n is a, c, g, or t
  modified_base (647)..(650): a, c, t, g, unknown or other
  misc_feature (647)..(650): n is a, c, g, or t
  modified_base (653)..(654): a, c, t, g, unknown or other
  misc_feature (653)..(654): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaggcgaccttaatttataaggtttctaaccgggactcgtggggtcccagacagattcagcggcagtggtcaggcactgatttcacactgagaatcagcgagggtggaggctggaggtatggtttagggggtttattacgtgtcttgactaaggtacactacgtcgggtactcgttttcgggaccgtaagggggaccctaaaggcgttacggggaagtaacgttaacgaaaacggtaaccgtgggtacgggtacttacggacctaacccgtagttccttacgttcctttactaacgttcccctttaccccggtcccttaaacttccgttacgtaacccgttacggtttaccgttaacccggtcgttacgggaaccgggtccgggggtccgttaacgggggtaccgaaacgggggtccgacccgaaagttaagggcgngngnngnnnntgnn

SEQ ID NO: 321708 - DNA, 567 bp, Homo sapiens
  misc_feature: GZ8MTXP01CPPW2.17.11.A11.1.454.CMB.2.raw
  modified_base (416)..(416): a, c, t, g, unknown or other
  misc_feature (416)..(416): n is a, c, g, or t
  modified_base (555)..(555): a, c, t, g, unknown or other
  misc_feature (555)..(555): n is a, c, g, or t
  modified_base (557)..(567): a, c, t, g, unknown or other
  misc_feature (557)..(567): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacactacttgaattggttcaacagaggccaggccaatctaccaaggcgacctaaatttataaggtttccaaccgggtactcgtggggtcccagacagattcaggcggcaggtgggtcaggcactgatttcgacactgagaatcagcgaggggtggaggcgtggaggtatggtttggggtttattacgtgtcttgacaaggtacacacgtggtaactcgttttcgggaccgtaagggggacccaaggctaacggganacgtacgaaaacgacgtgtaggcgtagtaccactattcttgtcttaccgtacttcccgtacccgtcctaatccgtaggtaacctacgttacctaccggctagggaacgcgggtccgtgggcgaaagggcacgtagtagngnnnnnnnnnnn

SEQ ID NO: 321709 - DNA, 489 bp, Homo sapiens
  misc_feature: GZ8MTXP02I9BE1.17.11.A11.1.454.CMB.2.raw
  modified_base (478)..(478): a, c, t, g, unknown or other
  misc_feature (478)..(478): n is a, c, g, or t
  modified_base (480)..(480): a, c, t, g, unknown or other
  misc_feature (480)..(480): n is a, c, g, or t
  modified_base (482)..(489): a, c, t, g, unknown or other
  misc_feature (482)..(489): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaggcgcctaatttataaggtttctaaccgggactctggggtcccagacagattcagcggcagtgggtcaggcactgatttcacactgagaatcagcagggtggagctgaggatggttggggtttattactgtcttgcaaggtacacacttggtactacgtttttgggccgaagggggtaccaaagcgtagggagatacaaacgaactgtagctgcacatctgtcttcattcttcccgcatctgactagtctacgctgagcggctggcaggcganangnnnnnnnn

SEQ ID NO: 321710 - DNA, 392 bp, Homo sapiens
  misc_feature: GZ8MTXP02JYNC1.17.11.A11.1.454.CMB.2.raw
  modified_base (388)..(392): a, c, t, g, unknown or other
  misc_feature (388)..(392): n is a, c, g, or t
tcagcgtagactagcacgaccggtgctcgatttagctacgactgcaggtctagtgaaagcctcgtagacagtgatggaaacacctacttgaattggtttcaacagaggccaggccaatctccaaggcgcctaatttataaggtttctaaccgggactctggggtcccagacagattcagcggcagtgggtcaggcactgatttcacactgagaatcagcagggtggaggctgaggatgttggggttattactgcttgcaaggtacacactggtacacttttggccaggggaccaagctggagatcaaacgaactgtggctgcaccatctgtcttcatcttccgcccatctgactagtctacgctgagcgggctggcaaggcgcatagnnnnn

SEQ ID NO: 321711 - DNA, 474 bp, Homo sapiens
  misc_feature: GZ8MTXP02IHCUJ.17.11.A11.1.454.CMB.2.raw
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (468)..(474): a, c, t, g, unknown or other
  misc_feature (468)..(474): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaaggcgcctaaatttataaggtttctaaaccgggactctggggtcccagacagattcagcggcagtggtcaggcactgatttcacatgagaatcagcagggtgagctgaggatgttgggtttatactgcttgcaaaggtcacactggtaactacttttggaccaggggaccaagctaggagatacaaacgaactgtggctgcacatctgtntcatcttccgcatcngactagctacgctgagcgggntcggcaagggcananannnnnnn

SEQ ID NO: 321712 - DNA, 487 bp, Homo sapiens
  misc_feature: GZ8MTXP02FUJI7.17.11.A11.1.454.CMB.2.raw
  modified_base (479)..(487): a, c, t, g, unknown or other
  misc_feature (479)..(487): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaggcgcctaaatttataaggtttctaaccgggactctggggtcccagacagattcagcggcagtggtcaggcactgatttcacactgagaatcagcagggtggaggctgaggatgttggggtttatactgcttgcaaggtacacactggtacacttttggccagggggtaccaagctgggagatcaaacgaactgtaggctgcacatctgtctttcactcttcccgccatctgacctagtctacgctgagtcgggctaggcaaaggcgcagtagnnnnnnnnn

SEQ ID NO: 321713 - DNA, 480 bp, Homo sapiens
  misc_feature: GZ8MTXP02H1524.17.11.A11.1.454.CMB.2.raw
  modified_base (274)..(274): a, c, t, g, unknown or other
  misc_feature (274)..(274): n is a, c, g, or t
  modified_base (359)..(359): a, c, t, g, unknown or other
  misc_feature (359)..(359): n is a, c, g, or t
  modified_base (466)..(466): a, c, t, g, unknown or other
  misc_feature (466)..(466): n is a, c, g, or t
  modified_base (472)..(480): a, c, t, g, unknown or other
  misc_feature (472)..(480): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggttcaacagaggccaggccaaatctaccaaaggcgccttaaatttataaaggtttctaaaccgggactcgtggggtcccagacagattcagcggcagnggtcaggcactgattcacactgagaatcagcagggtgaggctgaggatgtgggttatactgcttgcaaggtacactactggtacncttttggcagggggaccaaagctaggagatacaaaacgaactgtaggctgcaccatctgtctcatcttcccgcatctgactagctacgctgagcggctggcaaggcncatagnnnnnnnnn

SEQ ID NO: 321714 - DNA, 485 bp, Homo sapiens
  misc_feature: GZ8MTXP02IPL7W.17.11.A11.1.454.CMB.2.raw
  modified_base (358)..(358): a, c, t, g, unknown or other
  misc_feature (358)..(358): n is a, c, g, or t
  modified_base (476)..(485): a, c, t, g, unknown or other
  misc_feature (476)..(485): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaggcgcctaaatttataaggtttctaaccgggactctggggtcccagacagattcagcggcagtggtcaggcactgatttcacactgagaatcagcagggtgaggctggagatgttggggtttattactgcttgcaaggtacacactggttacncgttttggcctagggggaccaagctaggagatacaaacgaactgtggctgcacatctgtcttcattccttcccgccatctgactagtctacgctgagcggctggcaaggcgcgatagnnnnnnnnnn

SEQ ID NO: 321715 - DNA, 523 bp, Homo sapiens
  misc_feature: GZ8MTXP02GUHHD.17.11.A11.1.454.CMB.2.raw
  modified_base (512)..(523): a, c, t, g, unknown or other
  misc_feature (512)..(523): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaggcgcctaatttataaggtttctaaccgggactcgtggggtcccagacagattcagcggcagtgggtcaggcactgatttcacactgagaatcagcagggtgaggctgaggatggttggggttattacgtgcttgctaaaggtcacgtacgttggtactacgttttggaccgagggggtaccaagcgtaggagatacgaaacgactgtggctgccacgactcgtcgtcttacgtacttccgttcccgcacttctacgacttagtcgtacgcgtgacggcggcgtcggacgaacggcgactacgacgnnnnnnnnnnnn

SEQ ID NO: 321716 - DNA, 516 bp, Homo sapiens
  misc_feature: GZ8MTXP02GMEM4.17.11.A11.1.454.CMB.2.raw
  modified_base (505)..(516): a, c, t, g, unknown or other
  misc_feature (505)..(516): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaggcgcctaatttataaggtttctaaccgggactctggggtcccagacagattcagcggcagtggtcaggcactgatttcacactgagaatcagcagggtgaggctgaggatggttggggtttattactgtcttgcaaggtacacacgtggtactcgttttcggccgaagggggtacccaaaggcgtagggaagaagtacgaaaacgaacgtggtaggctagccacatctagtcttacacttccttcccgcctactctagactagtctacgctgagcgggctcggcgaaggcgacactagnnnnnnnnnnnn

SEQ ID NO: 321717 - DNA, 635 bp, Homo sapiens
  misc_feature: GZ8MTXP02GYPDN.17.11.A11.1.454.CMB.2.raw
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (630)..(635): a, c, t, g, unknown or other
  misc_feature (630)..(635): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacactacttgaattggtttcaacagaggccaggccaatctccaaggcgcctaatttataaggtttctaaccgggactcgtggggtcccagacagattcagcggcaggtggtcaggcacgtgatttcacactgagaatcagcgagggtggagcgtgaggtagtggtttggggtttatacgtgtcgttcgacgtaaggtacacgtacgttacggttactcgtttttcgggaccgtaagggggaacccaaggcgtagggaagtaatacgaaaacgtaacgtggtcggactacggacctaacctaacgttcgttcggttacctttaccgtaacctttccccgttacccccggtaccgttaaccttcgttaccgtaaaccgtttacgttacccttacggtacgttcggtacgggccggggtcgttacggggtacgaacggggacccgtacgaacgttaacggcgcgngngcgacnnnnnn

SEQ ID NO: 321718 - DNA, 642 bp, Homo sapiens
  misc_feature: GZ8MTXP02H4U3M.17.11.A11.1.454.CMB.2.raw
  modified_base (626)..(626): a, c, t, g, unknown or other
  misc_feature (626)..(626): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (640)..(642): a, c, t, g, unknown or other
  misc_feature (640)..(642): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaatttggtttcaacagaggccaggccaatctccaaggcgccttaaatttataaggtttctaaaccgggactcgtggggtcccagacagattcagcggcagtggcaggcactgatttcacactgagaatcagcgaggggtggaggcgtgaggtagttggtttaggggtttattacgtgtctttagacgtaaacggtacaacgtacgttggttaactacgtttttgggaccgtaacgggggacctaaaggcgtagggtagaacgttaacgaaaacgtaacgtgtcggacgttcggaccaccgtaattaccgttcgttaccttacctaactttccccgtttacccccggtctaacgttccttacggtaaccttacgtaccgttaaccgtcgttacggtacggccgggggtcgttacgggggtacgaaacgggggccaaccggtaaacgttacggacgngagngnacncngcnnn

SEQ ID NO: 321719 - DNA, 524 bp, Homo sapiens
  misc_feature: GZ8MTXP02FU4H5.17.11.A11.1.454.CMB.2.raw
  modified_base (514)..(514): a, c, t, g, unknown or other
  misc_feature (514)..(514): n is a, c, g, or t
  modified_base (516)..(524): a, c, t, g, unknown or other
  misc_feature (516)..(524): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatcctacaaggcgaccttaatttattaaggtttctaaccgggactcgtcgggtcccagacagtattcagcggcaggtggtcaggcacgtgtactttcaacactgagaatcagcgaggggtggaggctaggaggtgttgggtttaggggtttatacgtgtcttgacgtaaggtacacgtacgtggtactacgtttggaccgaggggaccaagcgtagagatacgaaacgagtgtggcgtcgcacatctgtctctactcctccgctactctataccgtgtactacgtcgtgagcgggcgtcggacgacggcgctagcgngnnnnnnnnn

SEQ ID NO: 321720 - DNA, 685 bp, Homo sapiens
  misc_feature: GZ8MTXP02G5BVD.17.11.A11.1.454.CMB.2.raw
  modified_base (667)..(667): a, c, t, g, unknown or other
  misc_feature (667)..(667): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
tcagcgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaggcgcctaatttataaggtttctaaccgggactcgtggggtcccagacagattcagcggcaggtgggtcaggcactgatttcacactgagaatcagcgagggtggaggctaggagggattgggtttaggggtttattacgtgtctttcgacctaaggtacacgtacgtggttactaccgttttgggacccgtagggggaacccaaggcgttagggagtaactacgtaaaaccgtaaaccgttgggtaacggtccgttacggaccctaacccgtaactttacccgttacggttcctttaaaccgttaccttaccccgttttccccccggtacccttaacggttccttaccggtaaacccgtttaccggtttaccttaaacccgtccgttaagggtccgggaccggggtaccggttcgggaccggaaacggggtccccggtacggtaaacgtacgacgacgcgngcgacgcgagcncncncg

SEQ ID NO: 321721 - DNA, 527 bp, Homo sapiens
  misc_feature: GZ8MTXP01A500J.39.56.F01.1.454.CMB.2.raw
  modified_base (207)..(207): a, c, t, g, unknown or other
  misc_feature (207)..(207): n is a, c, g, or t
  modified_base (265)..(265): a, c, t, g, unknown or other
  misc_feature (265)..(265): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
  modified_base (361)..(361): a, c, t, g, unknown or other
  misc_feature (361)..(361): n is a, c, g, or t
  modified_base (391)..(391): a, c, t, g, unknown or other
  misc_feature (391)..(391): n is a, c, g, or t
  modified_base (434)..(434): a, c, t, g, unknown or other
  misc_feature (434)..(434): n is a, c, g, or t
  modified_base (447)..(447): a, c, t, g, unknown or other
  misc_feature (447)..(447): n is a, c, g, or t
  modified_base (522)..(522): a, c, t, g, unknown or other
  misc_feature (522)..(522): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccaggggaaanagccaccctctcctgcagggccagtcagagtgtagcagcacctacttagcctggaccngcagaacctggccaggctccaggcctcctnatctatggtncatccacagggccagtggcactccccganacggttcagtgcaggtgggctgggacngacttcactctcaccatcagcagactgganctgaagtatttgctagtgtattctgtacagctagtagtggtanctcctaccttccnccgttcggaccgttaagggaccacgacgtcggaagttacgttaaaacgaacgttggtcggctcgactaaccgttnttccg

SEQ ID NO: 321722 - DNA, 556 bp, Homo sapiens
  misc_feature: GZ8MTXP01BBD02.39.56.F01.1.454.CMB.2.raw
  modified_base (208)..(208): a, c, t, g, unknown or other
  misc_feature (208)..(208): n is a, c, g, or t
  modified_base (312)..(312): a, c, t, g, unknown or other
  misc_feature (312)..(312): n is a, c, g, or t
  modified_base (416)..(416): a, c, t, g, unknown or other
  misc_feature (416)..(416): n is a, c, g, or t
  modified_base (553)..(553): a, c, t, g, unknown or other
  misc_feature (553)..(553): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccgaggggaaangccaccctctcctgcagggccagtcagagtgttagcagcacctacttagcctggtaccagcaagaaacctggccaggctcccgaggcctcctcatctagtggtncactccacgacgggccacgtggaccacgtcccccgatacggttcaggtcggcgaggtcggggtctggggacagtacttcactcacaccatcagcagactggacncctagaacgtatttgactagttgttattacgtgtacagtctagtacgtggtactcctctacccttccaccgttcggacgttaagggcacggacgtagggacgttacttaaacgaacttggtcgctcgactaacgttntcg

SEQ ID NO: 321723 - DNA, 540 bp, Homo sapiens
  misc_feature: GZ8MTXP01CKV8X.39.56.F01.1.454.CMB.2.raw
  modified_base (209)..(209): a, c, t, g, unknown or other
  misc_feature (209)..(209): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (448)..(448): a, c, t, g, unknown or other
  misc_feature (448)..(448): n is a, c, g, or t
  modified_base (515)..(515): a, c, t, g, unknown or other
  misc_feature (515)..(515): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagcccaccctgtctttgtctccgaggggaaanagcccaccctctcctgcagggccagtcagagtgttagcagcacctacttagcctggtaccagcagaacctggccaggctcccagctcctnatctatggncatcccaccgagggcccacgtggcactccccgatacggttcaggtgcgaggtgggtctggggactaggtaccttcactctcacctatcagcagactggacgtccgtagaagtgtttcgctagtgttattacgtgtcaggntagtagtggtagtctctaccttccgccttcggaccgaagggcacggactggacgttacttaaacgtntgtcgcgtcgcgtaaccttaagtcg

SEQ ID NO: 321724 - DNA, 565 bp, Homo sapiens
  misc_feature: GZ8MTXP01DUELH.39.56.F01.1.454.CMB.2.raw
  modified_base (208)..(208): a, c, t, g, unknown or other
  misc_feature (208)..(208): n is a, c, g, or t
  modified_base (307)..(307): a, c, t, g, unknown or other
  misc_feature (307)..(307): n is a, c, g, or t
  modified_base (409)..(409): a, c, t, g, unknown or other
  misc_feature (409)..(409): n is a, c, g, or t
tcagtcgcactagtcacgaccggtgctcgatttagcagacgtctgaacacacaaaggggggagaagagctgctcagttaggacccagagggaaccatggaaaccccagcgcagcttctcttcctcctgctactctggctcccagataccaccggagaaattgtgttgacgcagtctccagccacctgtctttgtctccgaggggaaancgccaccctctcctgcagggccagtcagagtgtagcagcacctattagcctggtacagcagaaacctggccaggctcccaggcctcctcatctatggtncactccacgagggccacgtggccactccccgatacggttcaggtcggcaggtcgggtctggggactaggtaccttcactctcacatcgagcagacgtggacncgtagtaacgtatttcgactagttgttattacgtgtacagtcaagtgtggtacgctccgtacttcccaccgttcggacttacggggaccacggtaacgtaggaacgaacgtttaaaaccgaagttggtaacgctcggacctaaccgttaagttccg

SEQ ID NO: 321725 - DNA, 732 bp, Homo sapiens
  misc_feature: GZ8MTXP01AJ2UY.39.56.F01.1.454.CMB.2.raw
  modified_base (209)..(209): a, c, t, g, unknown or other
  misc_feature (209)..(209): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagcccaccctgtctttgtctccgaggggaaangcccaccctctcctgcagggccagtcagagtgtagcagcacctacttagcctggtaccagcagaacctggccagctccagctctnatctatggtncatcccacgacgggccacgtggaccacgtccccgagtacggttcaggtggactagggtcggggtcctgggggactacggtacctttcgaccttctaccgaaccctatccgaacggcaaggaccgttaggggaccgtacccgttagggtaaacggttagtttttacggaccgttaaggtttacggtttaaacgtttaccgttagggttaccctaaagggttccctaaagggtttacgttacgggggtttaaccgtccccttaacccgttaaccccctttaccccggtaaccccggtttaacccggggaaacccgttaaacgggggtaccaaaccgggtaaaccggtaagggggttaaacgttaaaacgtttaaaaccggaaccgtttaggtaaccggtacgtaccggacctaacgttaacgttttcccg

SEQ ID NO: 321726 - DNA, 534 bp, Homo sapiens
  misc_feature: GZ8MTXP02GQ5W7.39.56.F01.1.454.CMB.2.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
  modified_base (355)..(355): a, c, t, g, unknown or other
  misc_feature (355)..(355): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgctccaggggaangtcacctctcctgcagggccagtcagagtgttagcagcacctacttagcctggtaccagcagaactggccaggctccaggcctcctnatctatggtncatcccacgagggcccagtggcactccccgancggttcagtgcaggtgggtcnggggacaggtacttcacctcacaccatcagcagacgtggacgcctagaagtatttgctagtgttattacgtgtcagcagtagtggtagtctactaccttcaccgttcggaccgtaacgggacacgtacgtaggacgtaacgttaaacgaacgtagtacggtactcgacctactacttcg

SEQ ID NO: 321727 - DNA, 521 bp, Homo sapiens
  misc_feature: GZ8MTXP02FXC8L.39.56.F01.1.454.CMB.2.raw
  modified_base (207)..(207): a, c, t, g, unknown or other
  misc_feature (207)..(207): n is a, c, g, or t
  modified_base (308)..(308): a, c, t, g, unknown or other
  misc_feature (308)..(308): n is a, c, g, or t
  modified_base (338)..(338): a, c, t, g, unknown or other
  misc_feature (338)..(338): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccaggggaaanagccaccctctcctgcagggccagtcagagtgttagcagcacctacttagcctggtaccagcagaaacctggccaggctcccaggctcctcatctatggtncatccaccagggcccagtggcatccccganaggttcagtggcagtggtctggggacagacttcactctcaccatcagcagactggancctagaagtntttgctagttgtattactgtcagctagtatggtagctcaccttccaccttcggaccctaaagggacacggacgtggaacgaattaaaacgaacgttagtggactgacacctatccg

SEQ ID NO: 321728 - DNA, 562 bp, Homo sapiens
  misc_feature: GZ8MTXP02FZNVJ.39.56.F01.1.454.CMB.2.raw
  modified_base (207)..(207): a, c, t, g, unknown or other
  misc_feature (207)..(207): n is a, c, g, or t
  modified_base (344)..(344): a, c, t, g, unknown or other
  misc_feature (344)..(344): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccaggggaaangccaccctctcctgcagggccagtcagagtgttagcagcacctacttagcctggtaccagcagaaacctggccaggcctcccaggcctcctcatctatggtgcatcccaccgagggcccacgtggccactccccganacggttcagtggcaggtgggtctggggacagacttcactctcaccatcagcagactggacgccgtagaagtatttgctagttgtattacgtgtacagactagttagtggtacgtctctaccttccaccgttacggaccgaaacgggaccacggtacgtaggaacgtaacgttaaaaccgaacgttaggtacggacgtacggacctacctacgtttccg

SEQ ID NO: 321729 - DNA, 480 bp, Homo sapiens
  misc_feature: GZ8MTXP02IJOSB.39.56.F01.1.454.CMB.2.raw
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (296)..(296): a, c, t, g, unknown or other
  misc_feature (296)..(296): n is a, c, g, or t
  modified_base (332)..(332): a, c, t, g, unknown or other
  misc_feature (332)..(332): n is a, c, g, or t
  modified_base (430)..(430): a, c, t, g, unknown or other
  misc_feature (430)..(430): n is a, c, g, or t
  modified_base (458)..(458): a, c, t, g, unknown or other
  misc_feature (458)..(458): n is a, c, g, or t
  modified_base (468)..(468): a, c, t, g, unknown or other
  misc_feature (468)..(468): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccacctgtctttgtctccaggggaaangccacctntcctgcagggccagtcagagtgttagcagcacctacttagcctggtacagcagaaacctggccaggctccccaggcctcctnatctatggtgcatccacagggccatggcatcccganaggttcagtgcagtggctggggacagacttcactctcaccatcagcagactgagcctgaagatttgcagtgtaattactgtcagcagtatggtagctnacttcgacttcggcaaggcagactgganataaacgaangtgctgcacatc

SEQ ID NO: 321730 - DNA, 508 bp, Homo sapiens
  misc_feature: GZ8MTXP02JYGFY.39.56.F01.1.454.CMB.2.raw
  modified_base (207)..(207): a, c, t, g, unknown or other
  misc_feature (207)..(207): n is a, c, g, or t
  modified_base (338)..(338): a, c, t, g, unknown or other
  misc_feature (338)..(338): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccaggggaaanagccaccctctcctgcagggccagtcagagtgttagcagcacctactagcctggtaccagcagaaacctggccaggctcccaggcctcctcatctatggtgcatccaccagggccactggcactccccganacggttcagtggcagtgggctggggacagacttcactctcaccatcagcagactggacgcctagaagtatttgctagttgtattactgtcagctagtatggtagctcaccttccaccttcggacaagggacacgactggacgaattaaacgaacgtgtacgctgcacatc

SEQ ID NO: 321731 - DNA, 582 bp, Homo sapiens
  misc_feature: GZ8MTXP02JT062.39.56.F01.1.454.CMB.2.raw
  modified_base (208)..(208): a, c, t, g, unknown or other
  misc_feature (208)..(208): n is a, c, g, or t
  modified_base (309)..(309): a, c, t, g, unknown or other
  misc_feature (309)..(309): n is a, c, g, or t
  modified_base (347)..(347): a, c, t, g, unknown or other
  misc_feature (347)..(347): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccaggggaaagngccaccctctcctgcagggccagtcagagtgttagcagcacctacttagcctggtaccagcagaaacctggccaggcctcccaggctcctcatctatggtnccatcccaccgagggcccacgtggaccactcccccganacggttcagtggcaggtgggctggggacagtcttcactctcaccatcacgcagactggacgtccgtagaagtatttgcgtagttgttattacgtgtacagtctagttagtggtagtctcctacccgttcctacccgttaccggaccgtaacggggaccacggtacgttacgggaacgttaacgttaaaaccggaacgttacggtacggtacctacggacctaaccgtactttccg

SEQ ID NO: 321732 - DNA, 548 bp, Homo sapiens
  misc_feature: GZ8MTXP02IWKW3.39.56.F01.1.454.CMB.2.raw
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagcccaccctgtctttgtctccaggggaaagagccaccctctcctgcagggccagtcagagtgttagcagcacctacttagcctggtaccagcagaaacctggccaggctcccaggctcctnatctatggtgcatccaccagggcccactggcactccccganacggttcagtggcaggtggtctggggacaggcttcactctcaccatcagcagactggacgcctagaagtatttgctagtgttattactgtcagcagtatggtagctctaccttccaccgttcggaccgtaacgggaccaacggtacgtacgggaacgtaacgttaaacggtaacgttcggtacggtactaggaccaccgtacttaccg

SEQ ID NO: 321733 - DNA, 555 bp, Homo sapiens
  misc_feature: GZ8MTXP02G3WSG.39.56.F01.1.454.CMB.2.raw
  modified_base (207)..(207): a, c, t, g, unknown or other
  misc_feature (207)..(207): n is a, c, g, or t
  modified_base (308)..(308): a, c, t, g, unknown or other
  misc_feature (308)..(308): n is a, c, g, or t
  modified_base (341)..(341): a, c, t, g, unknown or other
  misc_feature (341)..(341): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccaggggaaanagccaccctctcctgcagggccagtcagagtgttagcagcacctacttagcctggtaccagcagaaacctggccaggctcccaggctcctcatctatggtncatccaccgagggcccacgtggcactccccganacggttcagtgcagtgggtctggggacagacttcactctcaccatcagcagacgtggagcctagaagtatttgctagtgttattactgtcagtcagtatggtagctactaccttccaccgttccggaccgtaaagggaccacggtaaccgtagggaacgtaacgttaaaacggaacgtacggtacgggtacttacggacctaaccctattaccg

SEQ ID NO: 321734 - DNA, 523 bp, Homo sapiens
  misc_feature: GZ8MTXP02FRTQ0.39.56.F01.1.454.CMB.2.raw
  modified_base (162)..(162): a, c, t, g, unknown or other
  misc_feature (162)..(162): n is a, c, g, or t
  modified_base (207)..(207): a, c, t, g, unknown or other
  misc_feature (207)..(207): n is a, c, g, or t
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgngttgacgcagtctccagccaccctgtctttgctccgaggggaaangccaccctctcctgccagggccagtcagagtgttagcagcactattagcctggtaccagcagaaacctggccaggctccaggctcctcatctatggtncatccaccagggccagtcggcatccccgancggttcagtggctaggtcgggctggggacaggacttcactcgtcaccatccagcagactgagcctagaatatttgctagttgtattacgngtcagcagtgtggtacnctcaccgttcaaccgttcgacccgaagggaccacgtaactgggaactacttaaaacgaacgtgtaggctagacactacttc

SEQ ID NO: 321735 - DNA, 568 bp, Homo sapiens
  misc_feature: GZ8MTXP02G5IAX.39.56.F01.1.454.CMB.2.raw
  modified_base (206)..(206): a, c, t, g, unknown or other
  misc_feature (206)..(206): n is a, c, g, or t
  modified_base (305)..(305): a, c, t, g, unknown or other
  misc_feature (305)..(305): n is a, c, g, or t
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgctccaggggaaangccaccctctcctgcagggccagtcagagtgttagcagcacctactagcctggtaccagcagaaacctggccaggcctccaggctcctcatctatggtncatcccacgacgggcccacgtggaccacgtacccccgatacgggttccaggtcggcgtaggtgggtctggggacagtacttcactctcaccatcagcagactgggacnccgtagaaagtntttcgctaagttgttaattacgtgtacaggctaagttagtggtatcctacaccctttcaccgttcggacccgaaaggggtaccacggtaactggaaacgtaacgttaaaacgaacgttggtacggctacgacaaccctatccg

SEQ ID NO: 321736 - DNA, 734 bp, Homo sapiens
  misc_feature: GZ8MTXP02G0DCY.39.56.F01.1.454.CMB.2.raw
  modified_base (206)..(206): a, c, t, g, unknown or other
  misc_feature (206)..(206): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccacctgtctttgtctccaggggaaancgccaccctctcctgcagggccagtcagagtgttagcagcactacttagcctggtaccagcagaactggccaggctccgagctcctnatctagtggtncatccaccgagggcccagtcggccacgtcccccgatacggttccagtcggcgtagggttcgggtctcgggggactacggtacctttccgaaccttcctaccaaaccctactaccgaacggaccaaggtaccgttaggggacgtcccgtaagtaaacggttaagtttttcggaccgttaaggtttagtttaaacgtttccgttaggttacccgtagggtaccgttaaagggttaacggttggggttaacgtccgtttaccccgttaaccccgtttacccccgttaaccccggtttacccggggaaccccggtaaaagggggtaccccaaaccggttaaccggttacgggggtaaaacgttaaacgttaaaaaccgggtaaccgttagggttacgggaccgttacggacccctaaccttaacggtttacccg

SEQ ID NO: 321737 - DNA, 556 bp, Homo sapiens
  misc_feature: GZ8MTXP02G2LE2.39.56.F01.1.454.CMB.2.raw
  modified_base (207)..(207): a, c, t, g, unknown or other
  misc_feature (207)..(207): n is a, c, g, or t
  modified_base (338)..(338): a, c, t, g, unknown or other
  misc_feature (338)..(338): n is a, c, g, or t
  modified_base (387)..(387): a, c, t, g, unknown or other
  misc_feature (387)..(387): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccaggggaaanagccaccctctcctgcagggccagtcagagtgttagcagcacctacttagcctggtaccagcagaaacctggccaggctcccaggcctcctcatctatggtgcatccacagggccactggcactccccgancggttcagtgcagtcgggctggggacaggacttcactctacaccatcancagactggagcctagaagtatttgctagtcgttattacgtgtacagtacagtatggtacgctcctaccttccaccctttcggacccgtaaagggaccaccggacgtacgggaagtaacgtttaaaaccgaacgttaggtacggacttacggaccgtaacctagtttccg

SEQ ID NO: 321738 - DNA, 554 bp, Homo sapiens
  misc_feature: GZ8MTXP02FF15B.39.56.F01.1.454.CMB.2.raw
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
  modified_base (549)..(549): a, c, t, g, unknown or other
  misc_feature (549)..(549): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtcttttgtctccgagggaaagagccaccctctcctgcagggccagtcagagtgttagcagcacctacttagcctggtaccagcagaaacctggccaggcctcccaggcctccncatctatggtncatcccaccgagggccacgtggcactccccganacggttcagtggcaggtcgggtcgtggggacagtacttcacctctcaccatcagcagactggacnccgtagaacgtntttgcgtagtgtattactgtcagtcagtagtggtagctacctaccttccacccgttcggacctaaaggggaccaacggacgtagggaacgtaattaaaaccggaacgtggtacgcgtacgaccacctnttccg

SEQ ID NO: 321739 - DNA, 549 bp, Homo sapiens
  misc_feature: GZ8MTXP02I355J.39.56.F01.1.454.CMB.2.raw
  modified_base (206)..(206): a, c, t, g, unknown or other
  misc_feature (206)..(206): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (412)..(412): a, c, t, g, unknown or other
  misc_feature (412)..(412): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccaggggaangccaccctctcctgcagggccagtcagagtgttagcagcacctacttagcctggtaccagcagaacctggccaggcctcccaggcctcctnatctatggncatccacgagggccactggcactccccgganacggttcaggtgcaggtgggtctggggacaggtaccttcacttcncaccagtcancagactgacgctagaagttntgatagtgtattacgtgtacgagtactagtagtaggtactctacctaccttacccacgttaccggaccgaaacggacaccggtacgtacggaacgtaacgttaaacgtaagtggtacgtacgacgacctactactcg

SEQ ID NO: 321740 - DNA, 563 bp, Homo sapiens
  misc_feature: GZ8MTXP02FML2I.39.56.F01.1.454.CMB.2.raw
  modified_base (208)..(208): a, c, t, g, unknown or other
  misc_feature (208)..(208): n is a, c, g, or t
  modified_base (308)..(308): a, c, t, g, unknown or other
  misc_feature (308)..(308): n is a, c, g, or t
  modified_base (470)..(470): a, c, t, g, unknown or other
  misc_feature (470)..(470): n is a, c, g, or t
  modified_base (550)..(550): a, c, t, g, unknown or other
  misc_feature (550)..(550): n is a, c, g, or t
  modified_base (559)..(559): a, c, t, g, unknown or other
  misc_feature (559)..(559): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccgaggggaaangccaccctctcctgcagggccagtcagagtgttagcagcacctattagcctggtaccagcagaacctggccaggcctccgaggcctcctcatctatggtncactccaccgacgggcccacgtcggccactcccccgatacggttccaggtggcgaggtggggtctggggacacggtacttcgacttcctacacccatcacgtcacgacgtggacgccgtaaggtaacgttagtttagcgtaagttcgttagttacctgtacngactagttagtgtacgtctcctacctccgtacgttccgacgtacggactacgcgtagaactagtaaacgcgtgacggtcncgtacactnttcg

SEQ ID NO: 321741 - DNA, 532 bp, Homo sapiens
  misc_feature: GZ8MTXP02JSQPR.39.56.F01.1.454.CMB.2.raw
  modified_base (204)..(204): a, c, t, g, unknown or other
  misc_feature (204)..(204): n is a, c, g, or t
  modified_base (374)..(374): a, c, t, g, unknown or other
  misc_feature (374)..(374): n is a, c, g, or t
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (443)..(443): a, c, t, g, unknown or other
  misc_feature (443)..(443): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtcttgtctcaggggaanagccacctctcctgcagggccagtcagagtgttagcagcacctacttagcctggtaccagcagaaacctggcccaggcctcccaggcctcctcatctatggtgcatccacgagggtccacgtggccactcccccggataccgggttcaggtgcaggtgggtctggggacnggtactcgactcncaccatcagcagcnggacnctgaagtatttgctagtgtattactgctagcagttanggtagctctacctccacgttccggacgtaagggacacggtacgtaggaacgtaagttaaaacgctaggtcgcgcgtacaaccttactcg

SEQ ID NO: 321742 - DNA, 704 bp, Homo sapiens
  misc_feature: GZ8MTXP02JDUYZ.39.56.F01.1.454.CMB.2.raw
  modified_base (206)..(206): a, c, t, g, unknown or other
  misc_feature (206)..(206): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccacctgtctttgtctccgaggggaangccaccctctcctgcagggccagtcagagtgtagcagcacctattagcctggtaccagacaaaacctggccagacctcccaggcctcctcatcgtatggtgcgtcccaccgaggggccccaacgttcggtactccccgacgtcccgtaggtttccaaggttcgggcgtaacggttcggggtcccgtaggggaaccaggggtacgtttaccgacggttaccttaccgaaccctaatccgaaacggcaacgtcccgtgaccgtagtacctaggtaaagttactttttaggtaccttttaatttaccgtagtttaccgaagtaccgtaaggttaagttacgtaaagttaccccgtacgggtccccttactaacccgttaaccggtttttcggggaacccggtaacgggggtacccgtaggggtttacgggaacgtaacgtaccgtaaaaccgtaaccgtggtaacggacttacggactaacccgtatccgttacgtttccg

SEQ ID NO: 321743 - DNA, 668 bp, Homo sapiens
  misc_feature: GZ8MTXP02F3D5X.39.56.F01.1.454.CMB.2.raw
  modified_base (208)..(208): a, c, t, g, unknown or other
  misc_feature (208)..(208): n is a, c, g, or t
  modified_base (342)..(342): a, c, t, g, unknown or other
  misc_feature (342)..(342): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccgaggggaaanagccaccctctcctgcagggccagtcagagtgtagcagcactactagctggtaccagcagaactggccaggcctccaggcctcctcatcctatggtgcactccaccgacgggccacgtcggccacgtccccganacggttcagtcggcagtcggggtctggggactacggacttcactctcaccatcgagtcgaacgacgtcggagcccgtaggaaacgttagttttacgacgttacggttagttaaaactttcgtacgtttaccgaaggtaccgtaaggttaacggttggggttaaccgtccgtttacccctaaccccggtttacccctacccggtttacccgggaaacccggtaaacgggggaccaaaccgggtaacgtacgggtaaacgtaaaacgtttaaaaccggaaaacgtttcggaacggtccggttaccggtaccaacccgtagtttacccg

SEQ ID NO: 321744 - DNA, 725 bp, Homo sapiens
  misc_feature: GZ8MTXP02JIIR6.39.56.F01.1.454.CMB.2.raw
  modified_base (208)..(208): a, c, t, g, unknown or other
  misc_feature (208)..(208): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccaggggaaagngcccaccctctcctgcagggccagtcagagtgttagcagcacctacttacgcctggtaccagcacgaaacctggccaggcctcccgaggcctcctcatctagtcggtgcactccaccgacgggcccacgtcggccaccgtacccccgagtaccggttcaggtcggccgtagggttcggggtctgggggaccacggtacctttaccgaccgttcctaccgaaccctactccgacgtaccaacggtacgtacgggacgtcccggttaggtaaacgttacgtttttacggaccgttaaaggttcggtttaaacgttttaacgttacggttacgtacgggtaccgtaaggttagttacggggttaacgtccgtttacccttaccccgtttaccccgtaacccggtttacccgggacccgtaaacggggaccgtaaaccggtaacgttacgggtaaacgttaaacgttaaaaccggtaacgttacggtacggtaccgttacggaccctaccgtactttaccg

SEQ ID NO: 321745 - DNA, 644 bp, Homo sapiens
  misc_feature: GZ8MTXP02IX9J4.39.56.F01.1.454.CMB.2.raw
  modified_base (207)..(207): a, c, t, g, unknown or other
  misc_feature (207)..(207): n is a, c, g, or t
  modified_base (290)..(290): a, c, t, g, unknown or other
  misc_feature (290)..(290): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagcccaccctgtctttgtctccaggggaangccacctctcctgcagggccagtcagagtgttagcagcacctattagcctggtaccagcagaactggccaggctccagctccnatctatggtgcatccacagggcccagtcggctactccccgatacggttcagtggctaggttcggggtactgggggactacggtacctttcgaccttccgtacacctagtcagcagactggacgtcccgtagtaacgttagtttgactaggttagttattacgttgtaccgtaggtaacctaggttagtagggttacgtaccttacccgttacccgtttacccgtacccccgtttaccggggacccgttaaaacgggggaccctaaacgggtaaccggttagggaaacgttaaccgtttaaaaaccggaaccgttgggttacggtaccgttacggtaccctaacttacgtttccg

SEQ ID NO: 321746 - DNA, 569 bp, Homo sapiens
  misc_feature: GZ8MTXP02JCN64.39.56.F01.1.454.CMB.2.raw
  modified_base (206)..(206): a, c, t, g, unknown or other
  misc_feature (206)..(206): n is a, c, g, or t
  modified_base (263)..(263): a, c, t, g, unknown or other
  misc_feature (263)..(263): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (337)..(337): a, c, t, g, unknown or other
  misc_feature (337)..(337): n is a, c, g, or t
  modified_base (403)..(403): a, c, t, g, unknown or other
  misc_feature (403)..(403): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccaggggaangccaccctctcctgcagggccagtcagagtgttagcagcactacttagcctggaccngcagaacctggccaggcctcccgaggcctccnatctatggtncatcccacgagggcccatcggcactccccganacggttcagtcgcaggtcggctggggacaggtaccttcactctacaccatcagcagaccgtggacncctagaacgttagtttgactagttgttatttacgtgtacgagactagttagtcggtagtccttactacccgttcctacccgttacggaccgaaagggaccgtaacgacgttcggaaacgtaacgttaaaacgaacgttggacggtctacggacctacctatttccg

SEQ ID NO: 321747 - DNA, 555 bp, Homo sapiens
  misc_feature: GZ8MTXP02FJ7TF.39.56.F01.1.454.CMB.2.raw
  modified_base (207)..(207): a, c, t, g, unknown or other
  misc_feature (207)..(207): n is a, c, g, or t
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (336)..(336): a, c, t, g, unknown or other
  misc_feature (336)..(336): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccaggggaaanagccaccctctcctgcagggccagtcagagtgttagcagcacctacttagcctggtaccagcagaaacctggccagctccaggctccncatctatggtncatccaccagggccactggcactccccganacggttccagtggcagtgggtctggggacagacttcactctcaccatcagcagactggacgcctagaagtatttgctagttcgtatttactgttacagcagttatggtacgtctctaccttcctacccgtttcggaccgtaaacggggtacctacggaacgttcgggaagtaacgttaaaacgaaccgtggtacggcttacggaccaacccagtttccg

SEQ ID NO: 321748 - DNA, 772 bp, Homo sapiens
  misc_feature: GZ8MTXP02GMH42.39.56.F01.1.454.CMB.2.raw
  modified_base (204)..(204): a, c, t, g, unknown or other
  misc_feature (204)..(204): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgctccagggaangccaccctctcctgcagggccagtcagagtgttagcagcacctacttagcctggtaccagcagaaacctggccaggctcccaggcctcctcatctatggtgccactcccgaccgacggggcccacgtcggaccacgtaccccccgagtacgggttcacggtcgggcgtagggttcggggttcgtcgggggtaaccaacgggtacctttccgaaccgttccctacccgaaaccctaacgtacccgaaacgaccgaaacggaccgttacggggaacccgtaccccgttaggtaaaacggtttagtttttacggaccgttaaaggtttacgtttaaacgtttaacggtttacgttacgtacggtaccgttaaggtaacgtttacggggtaacgtcccttacccgtaaccccgtttaccccgtaaccccgtttacccggggaaccccggttaaagggggaaccctaaaccggtaaccggttaacggggtaaaccgttaaaacggtttaaaaacccggaacgtttacgggtaccgggtaccgttaccgacccgttaaccctaacgtttcccgg

SEQ ID NO: 321749 - DNA, 811 bp, Homo sapiens
  misc_feature: GZ8MTXP02F6874.39.56.F01.1.454.CMB.2.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagataccaccggagaaattgtgttgacgcagtctccagccaccctgtctttgtctccgaggggaaanagccaccctctcctgcagggccagtcagngtgttagcagcacctactacgcctggtaccagacagaaacctggccaggcctcccgaggcctcctcatctagtggtcgactactccgacgacgggcccacgtcggaccacgtcccccgtacgtacggttcgaggtcggaccgttagggtcggggttaccgtgggggacctaacggtaccgtttaccgaccttaccgtaccgaccctacgttaccgaacggaccgtaaacggtaaccgttcggggaaacgttaccccgttaaggtaaaggtttactttttacggaccgtttaagggggtttactttaaacgttttaacgttcgggttaacgtaacggttaccgttaaacgtttagggttacgggttaccggttacctttacccccggttaaaccccttttacccccgtaacccggttttaccccggggaaaccccgggttaaagggggtaaaccccgttaaaccgggtaacgttacgggggaaaaacggtttaaaccttttaaaaaacccggggaaggtttacgggttaaccgggtacgtcccgggtaaacccgtaacccttaagttttccccgg

SEQ ID NO: 321750 - DNA, 717 bp, Homo sapiens
  misc_feature: GZ8MTXP02I2CD4.39.56.F01.1.454.CMB.2.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (283)..(283): a, c, t, g, unknown or other
  misc_feature (283)..(283): n is a, c, g, or t
tcagtcgcactagtcacgaccggtgctcgatttagcagacgtctgaacacacaaagggggagaagagctgctcagttaggacccagagggaaccatggaaaccccagcgcagcttctcttcctcctgctactctggctcccagactaccaccggagaaattgtgttgacgcagtctccagccacctgtcttgtctcgaggggaanacgccacctctctgcagggccagtcagngtgtagcagcacctactcgctggtaccagcagaaacctcgaccaggcccnccgaggtcctcctctactctagtggtcacctactacccgaccgacggaccctacgtcggacctaccgtaccccgtacgtacggttcgaggttcgacgtaggtcggtcgtggggactacgtactactacgtactcaactactcgaacgcgacggtacgtacgggacgtaccgtaaaggtaacgtttatttacgacgttaagggtttacttaacgtttaacggtctaaccggtacgtagtaaaacgggtttgtacggggttaccgtaccttacccgttaccccgtttacccgtaacccgggtttacccgggaaacggttaaaaccgggaacccgtaacgggttaaaccggtacggtaaaacgttaaaaccgttaaaaccgggtaaacgttcggggttacggtacctaacggacccgttaaacgtactttaacccgg

SEQ ID NO: 321751 - DNA, 525 bp, Homo sapiens
  misc_feature: GZ8MTXP01DZ3ST.25.76.G10.1.454.CMB.2.raw
  modified_base (196)..(196): a, c, t, g, unknown or other
  misc_feature (196)..(196): n is a, c, g, or t
  modified_base (271)..(271): a, c, t, g, unknown or other
  misc_feature (271)..(271): n is a, c, g, or t
  modified_base (507)..(507): a, c, t, g, unknown or other
  misc_feature (507)..(507): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaangccacgctctcctgcagggccagtcagagtatcggcaggtccttagcctggtatcgacagagccctggccaggcnccccaggctcctcatctatgatgcatccaaacagggccactgaccgtcccagacaggttcagtggccaggtgggtctgggacaagacttcactctcaccatcagcagtctagagctagaagtattttgactagtttattactgaccagcgagcgtagcgactcggcctacgtactaagtttggaccgtaggggccgtaaggggtgacttacgaatcggaacttggttggcctggcncctatcttgtcttctaac

SEQ ID NO: 321752 - DNA, 548 bp, Homo sapiens
  misc_feature: GZ8MTXP01C6JG9.25.76.G10.1.454.CMB.2.raw
  modified_base (295)..(295): a, c, t, g, unknown or other
  misc_feature (295)..(295): n is a, c, g, or t
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (479)..(479): a, c, t, g, unknown or other
  misc_feature (479)..(479): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaagtccctgagactctcctgtgcagtgtccgcgtccacctccgtcgtttggcattcactgggtccnccaggctccaggcaagggactgggagtgggtggcggtcatagtggtgggatgggaaagtatgctaattttagngcagtactcgagacggccactcacatcncagacgcacgctacaanactactttanctagactaagttacgaaacgtgaacgactacgacgactacggtctcgtctaatcgngcggcgggtctaggaaacgacgttacggggtccgggaccgtcgacggcttacggtcgggaaccgtccgg

SEQ ID NO: 321753 - DNA, 566 bp, Homo sapiens
  misc_feature: GZ8MTXP01CSW0V.25.76.G10.1.454.CMB.2.raw
  modified_base (197)..(197): a, c, t, g, unknown or other
  misc_feature (197)..(197): n is a, c, g, or t
  modified_base (278)..(278): a, c, t, g, unknown or other
  misc_feature (278)..(278): n is a, c, g, or t
  modified_base (518)..(518): a, c, t, g, unknown or other
  misc_feature (518)..(518): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaanagccacgctctcctgcagggccagtcagagtatcggcaggtccttagcctggtatcgacagacgccccgtggccaggtccnccccgaggccctcctcatctatgatgcaatcccaaacgacgggccacgtgacccgtccccaagacctagggttcaggtggaccctagggtggggtctggggaactaaggtacctttcaacttcacaccatcagcatcagacgctagaagtattttgattagtttattactgaccagcagcgtagcgactcggcctcgtaactaagtttcggaccgtagggccgtaagggtcgacgttcgngttacgaacgttggttcggctgctaacctatcgttcttccttctcccg

SEQ ID NO: 321754 - DNA, 516 bp, Homo sapiens
  misc_feature: GZ8MTXP01AUFY6.25.76.G10.1.454.CMB.2.raw
  modified_base (196)..(196): a, c, t, g, unknown or other
  misc_feature (196)..(196): n is a, c, g, or t
  modified_base (271)..(271): a, c, t, g, unknown or other
  misc_feature (271)..(271): n is a, c, g, or t
  modified_base (302)..(302): a, c, t, g, unknown or other
  misc_feature (302)..(302): n is a, c, g, or t
  modified_base (381)..(381): a, c, t, g, unknown or other
  misc_feature (381)..(381): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaangccacgctctcctgcagggccagtcagagtatcggcaggtccttagcctggtatcgacagagccctggccaggcncccgaggctcctcatctatgatgcatccaangggccactgacctcccagacaggttcagtggccaggtgggctgggacaagacttcactctcaccatcaagcagtctagngcctgaagtatttgctagtttattactgaccagcagcgtagcgacgtcggcctccgtactagtttcggacgtacgggggaccgaagggtcggacttacgaagtcgaacttgttgctgcaacatcttcgtcttctc

SEQ ID NO: 321755 - DNA, 510 bp, Homo sapiens
  misc_feature: GZ8MTXP01BNX4Y.25.76.G10.1.454.CMB.2.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (359)..(359): a, c, t, g, unknown or other
  misc_feature (359)..(359): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaangccacgctctcctgcagggccagtcagagtatcggcaggtccttagcctggtatcgacagagccctggccaggctccccaggctcctcatccacggtncatccaccagggccactggaattccagccaggttcagtgcagtcgggtctggggacagacttcnctctcaccatcagcagccctgcagtctgacgtattttgctagtttatactgtcagcaggtaataaaactggacgtatgtttgcgtaggggacagcgtggacaatcagacgacgtgtggcttgcaaccatctgtcttctaacttcttccccg

SEQ ID NO: 321756 - DNA, 520 bp, Homo sapiens
  misc_feature: GZ8MTXP01DX4S2.25.76.G10.1.454.CMB.2.raw
  modified_base (196)..(196): a, c, t, g, unknown or other
  misc_feature (196)..(196): n is a, c, g, or t
  modified_base (505)..(505): a, c, t, g, unknown or other
  misc_feature (505)..(505): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaangccacgctctcctgcagggccagtcagagtatcggcaggtccttagcctggtatcgacagagccctggccaggctcccaggctcctcatctatgatgcatccaacagggccactgacccgtcccagacaggttcaggtggccaggtgggtctggggacaagacttcactctacaccatcagcagtctagagctgaagtattttgctagtttattactgtacagtcgagcgtagcgacgtcggccttcgtaactagtttggaccgaggggccaagggtcggacttcgaagtcgaacttggttcggctgcnctatcttgtcttctc

SEQ ID NO: 321757 - DNA, 595 bp, Homo sapiens
  misc_feature: GZ8MTXP01D8147.25.76.G10.1.454.CMB.2.raw
  modified_base (258)..(258): a, c, t, g, unknown or other
  misc_feature (258)..(258): n is a, c, g, or t
  modified_base (307)..(307): a, c, t, g, unknown or other
  misc_feature (307)..(307): n is a, c, g, or t
  modified_base (389)..(389): a, c, t, g, unknown or other
  misc_feature (389)..(389): n is a, c, g, or t
  modified_base (445)..(445): a, c, t, g, unknown or other
  misc_feature (445)..(445): n is a, c, g, or t
  modified_base (455)..(455): a, c, t, g, unknown or other
  misc_feature (455)..(455): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcggaggtcggggggagcgtggtccaggccgggggaatccctgacgactctcctgngcagtcgtccgcgtcctacctccgtcgtttgctattcacgtcgggtccnccgaggctaccgaggccaaggggctgggaggtgggtggcggtcagtagtgggtggaatgggaaatagtgacttaagttttangacagtacctccggtaggaacgggccactcaccatcacagacgcagcctaccaaanactactttanctggactaagttacgaaaccgtgacacgtacgaacgacacggtcttagtcttaattcgttggccggttcggggtactaagggaacggaccggttaggggtccgggcctcggtacggcttaggtccggaaccggtcccggg

SEQ ID NO: 321758 - DNA, 519 bp, Homo sapiens
  misc_feature: GZ8MTXP01AES7S.25.76.G10.1.454.CMB.2.raw
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
  modified_base (462)..(462): a, c, t, g, unknown or other
  misc_feature (462)..(462): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggagcctggtcaagccgtgggggtccctgagactctcctgtgtagcctccggattcagcttcagcaaatatagtgtgaacgtgggtccgccaggctccgaggggaggggctgggagtgggtcgctagttcgtgagtagtagtagtacttataaactactacgcagagtcagtggaggccgattcactanctcaganacaacacagagctattttgttacngactaaatgaacncggctaggagacgcgagatcgctntgtatgttgncgananagtaagaagagngngngtgtgtgacgacgtcggcggaacgg

SEQ ID NO: 321759 - DNA, 688 bp, Homo sapiens
  misc_feature: GZ8MTXP01D1VCF.25.76.G10.1.454.CMB.2.raw
  modified_base (305)..(305): a, c, t, g, unknown or other
  misc_feature (305)..(305): n is a, c, g, or t
  modified_base (392)..(392): a, c, t, g, unknown or other
  misc_feature (392)..(392): n is a, c, g, or t
  modified_base (503)..(503): a, c, t, g, unknown or other
  misc_feature (503)..(503): n is a, c, g, or t
  modified_base (589)..(589): a, c, t, g, unknown or other
  misc_feature (589)..(589): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtggcggaggtcggggggagcgtggtccaggccgggaagtccctgagactctcctgtgcagtcgtccgcgtccaccgttccgtcgtttgctattcacgtcgggtcccnccaggcctccgaggcgaaagggctgggaggtggggtggcggtcagtagtgggtagggatgggaaagtaagtgacttaaagtttttanggctaaggtacccgttccggtagggaaacggggccctaactccgaacctattcccgaccgaaggaacgggaccaaggcctaacccgaaaagtaaacccttacctttttaanaccgttaggtaacgtaaagtttacggaaaaccggttgaacgtaccgtacgaaccgactaccgggtacttcggtcttaagttaccgngggtcccgggttacgggggttactagggaaacggttacggttacgggggtcccggggtaccctcggtaacggcgttacggtcgggaacccggtccgggg

SEQ ID NO: 321760 - DNA, 582 bp, Homo sapiens
  misc_feature: GZ8MTXP01AT9YQ.25.76.G10.1.454.CMB.2.raw
  modified_base (339)..(339): a, c, t, g, unknown or other
  misc_feature (339)..(339): n is a, c, g, or t
  modified_base (381)..(381): a, c, t, g, unknown or other
  misc_feature (381)..(381): n is a, c, g, or t
  modified_base (447)..(447): a, c, t, g, unknown or other
  misc_feature (447)..(447): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtgggcggaggtcgggggaggcgtggtccagccggggaatccctgagactctcctgtgcagtgtccgcgtccacctcgtcgtttgctattcacgtgggtccgccaggcctccgaggcaaggggactgggagtggggtgcggtnagtagtgggtgggatgggaaagttatggtactaatttttagngcaggtactccggtaggaacgggccactcacatctccagcgcagctaccgaaagaactacctttanctaggactaaagttacgaaaacccgtgaacgaccgtacggacgaccgtacggccttagtcctaattacttggcgcggggtctaggaacgacgttacgggcggggcccgtaagtcggacagtcggaaccgtccggg

SEQ ID NO: 321761 - DNA, 509 bp, Homo sapiens
  misc_feature: GZ8MTXP01AS5GM.25.76.G10.1.454.CMB.2.raw
  modified_base (197)..(197): a, c, t, g, unknown or other
  misc_feature (197)..(197): n is a, c, g, or t
  modified_base (272)..(272): a, c, t, g, unknown or other
  misc_feature (272)..(272): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaangccacgctctcctgcagggccagtcagagtatcggcaggtccttagcctggtatcgacagagccctggccaggcncccaggctcctcatctatgatgcatccaacgagggtccactgacgtcccagacaggttcaggtggccaggtggtcngggacagacttcactcncaccatcagcagtctagacgcctgaagtatttgactagtttattactgccagcagcgtagcgtactgcctcgtactagtttcggacgaggggccaagggtcgacgttacagtcgaacttggttgctgcnccntcttntcttctc

SEQ ID NO: 321762 - DNA, 529 bp, Homo sapiens
  misc_feature: GZ8MTXP01DNUU7.25.76.G10.1.454.CMB.2.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (515)..(515): a, c, t, g, unknown or other
  misc_feature (515)..(515): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaangccacgctctcctgcagggccagtcagagtatcggcaggtccttagcctggtatcgacagagccctggccaggctcccaggctcctnatctatgatgcatccaacagggccatgaccgtcccagacaggttcagtggcaggtggtctgggacaagacttcactctcacatcagcagtctagagcctagaagtattttgctagtttattactgacagcgaagtcgtaagcgacgtcggccgttaccgtaactaagttttcggaccgtacggggaccgaaggggtgacgttcgaagtcgaacgttggttggctgctaaccntcttgtcttctaac

SEQ ID NO: 321763 - DNA, 641 bp, Homo sapiens
  misc_feature: GZ8MTXP01AT4YE.25.76.G10.1.454.CMB.2.raw
  modified_base (481)..(481): a, c, t, g, unknown or other
  misc_feature (481)..(481): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgcttgggttttccttgttgcttatttagaaggtgtctgtgtgaggtgcaactggtggagtcgtggggagcctggtcaagccgtgggggtcctgagactctctgtgtagcctcggattcagtcttcagacaaatatagtgtgaacgtcgggtcccgccgaggcctaccggaagggggacggggtcgtgggaggtggggtcgctagtttcggtgagttagttagtagtacttaataaactactagcagtagtaacaggtggagggccgtattacatactctaccgaagacaacaaccaacgaaagacgtacttaatttttcgttacagactaaaattcgaaacngggaccctagggaacgacggaccgaaggtataaccgggtccttacgttagtttaatttaggttggtaacggcgttaaagaacttaaagtaaaagaacgttagagggttcggcgttggggtctttagggaccgttacggccgggggttaacctaaccgggg

SEQ ID NO: 321764 - DNA, 629 bp, Homo sapiens
  misc_feature: GZ8MTXP01CU8LB.25.76.G10.1.454.CMB.2.raw
  modified_base (196)..(196): a, c, t, g, unknown or other
  misc_feature (196)..(196): n is a, c, g, or t
  modified_base (383)..(383): a, c, t, g, unknown or other
  misc_feature (383)..(383): n is a, c, g, or t
tcagactgtacagtcacgaccggtgctcgatttagtcactcatacagggggaggaactgctcagttaggacccagagggaaccatggaggccccagctcagcttctcttcctcctgctactctggcctcccagaaaccaccggcgaaattgtgttgacacagtctccagccaccctgtcttgtctccgaggggaangccacgctctcctgcagggccagtcagagtatcggcaggtccttagcctggtatcgacagacgccctggccaggcctcccaggcctcctcatctatgatgcatccaaacgcgggcccagtcgacccgtcccagacctaggttcagtggcctaggtgggtctggggacaagtaccttcgactctcacntcagcagtctagacgctagaagtatttgacttagtttattacgtgtaccgaagtcgaggtacggtacggaccgtacgtcggtcccgttaccggttaaccgttaaacgttttcgggaccggtaacgggggtacccgtaagggggttacggttaacgttacgaaacgttaccggtaacgttcggttcgggttccgttaacgggacccgtaacccgtacttccggttacgttccgtttccgttaacccg

SEQ ID NO: 321765 - DNA, 565 bp, Homo sapiens
  misc_feature: GZ8MTXP01DLWS8.25.76.G10.1.454.CMB.2.raw
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
  modified_base (420)..(420): a, c, t, g, unknown or other
  misc_feature (420)..(420): n is a, c, g, or t
  modified_base (482)..(482): a, c, t, g, unknown or other
  misc_feature (482)..(482): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtgggcggaggtcggggggagcgtggtccaggccggggaatccctgagactctcctgtgcagtcgtccgcgtccaccttccgtcgtttgctattcacgtgggtccncaggctccaggcaagggctggagtgggtgcgtnatgnggtggatgggaatatgctaatttangcagactcgngagggccactcacatcncagagcagctaccaagaacctactttanctggactaagttacgaaaccgtgacgtactacgaacgtcacggtctgtcttaatttaccggnggtccgggttcgggtactagggaaacggacggttacgggggtcccgggaccgtcggacggcgttaggtcgggaaccggtccgg

SEQ ID NO: 321766 - DNA, 689 bp, Homo sapiens
  misc_feature: GZ8MTXP01BXQPZ.25.76.G10.1.454.CMB.2.raw
  modified_base (198)..(198): a, c, t, g, unknown or other
  misc_feature (198)..(198): n is a, c, g, or t
tcagactgtacagtcacgaccggtgctcgatttagtcactcatacaggggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaangccacgctctcctgcagggccagtcagagtatcggcaggtccttagcctggtatcgacagacgccctggcccaggcctcccgaggccttccctcatctatgatcgacactacccgaaacgacggggacccctaacgttcggaaccccgttacccccaaggtaccgtaagggtttccaaggggttcgggacccgtagggggttggggtccgtagggggaacctaaacggttacctttccgaccttccctaccaacctatcgagctagtctagacgtccgtaggtaaagttagttttagtacttaagttttattacgtcgaccgtagacggtacggtacgtacgaccgtacgtccggtcccttaccgttaacgttacggtttcgggaccggtaacgggggaccggtaaggggtcggttaccgttacgaacgttacgtaacgttcggttcggttcgttcgcctaacctagttcgttacgttccttcgtaacccg

SEQ ID NO: 321767 - DNA, 520 bp, Homo sapiens
  misc_feature: GZ8MTXP01BQ9YY.25.76.G10.1.454.CMB.2.raw
  modified_base (273)..(273): a, c, t, g, unknown or other
  misc_feature (273)..(273): n is a, c, g, or t
  modified_base (332)..(332): a, c, t, g, unknown or other
  misc_feature (332)..(332): n is a, c, g, or t
  modified_base (356)..(356): a, c, t, g, unknown or other
  misc_feature (356)..(356): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (458)..(458): a, c, t, g, unknown or other
  misc_feature (458)..(458): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagactgtacagtcacgaccggtgctcgatttagtcactcatacaggggagagaggagccttagccctggattccaaggcctatccacttggtgatcagcactgagcaccgaggattcaccatggaactgggctccgctgggttttccttgttgctattttagaaggtgtcctgtgtgaggtgcaactggtggagtcgtgggggaggcctggtcaagcctgggggtccctgagactctcctgtgtagcctccggattcagcttcagcaaatnagtgtgaacgtgggtccgccaggctccgagggaaggggctggagtgggtcgcgattcgngagttagtagtagtacttataaanactacgcagagtcagtggaggccgattcatanctccaganacaacaccaaagtgctattttgttcnganaatagacagcagagagacgagagtacgtctctntattatgtgcgagagagaagaagacgngngtgtgtcgtcgtacgttacgtcggcggtaacgg

SEQ ID NO: 321768 - DNA, 556 bp, Homo sapiens
  misc_feature: GZ8MTXP01BFZBC.25.76.G10.1.454.CMB.2.raw
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
  modified_base (361)..(361): a, c, t, g, unknown or other
  misc_feature (361)..(361): n is a, c, g, or t
  modified_base (422)..(422): a, c, t, g, unknown or other
  misc_feature (422)..(422): n is a, c, g, or t
  modified_base (481)..(481): a, c, t, g, unknown or other
  misc_feature (481)..(481): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcgtcgttgctcttttaagaggtgtccagtgtcagatgcaactggcggagtcgggggagcgtggtccagccgggaagtccctgagactctcctgtgcagtgtccgcgtccacctccgtgtttggcattcactgggtccnccaggctccaggcaagggctggagtgggngcggtcagtatgggtggatgggaagtatgctaattttangcaggactcggtgaacgggccgaatcaccatctcagagcagcctacaagactaccttttanctacgactaagtacgaaacgtgacgtaccgtacgacgacgtcggtctcgtctaattcgnggccggttcgggtacaggaacgttaccggacggggtccgggtaccgtcggtacggcgttaggtcgggcggtccgg

SEQ ID NO: 321769 - DNA, 613 bp, Homo sapiens
  misc_feature: GZ8MTXP01A5R7V.25.76.G10.1.454.CMB.2.raw
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (382)..(382): a, c, t, g, unknown or other
  misc_feature (382)..(382): n is a, c, g, or t
  modified_base (482)..(482): a, c, t, g, unknown or other
  misc_feature (482)..(482): n is a, c, g, or t
  modified_base (547)..(547): a, c, t, g, unknown or other
  misc_feature (547)..(547): n is a, c, g, or t
  modified_base (599)..(599): a, c, t, g, unknown or other
  misc_feature (599)..(599): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgcttctttttaagaggtgtccagtgtcagatgcaacgtggcggaggtcggggggagcgtggtccaggccggggaagtccctgacgactctcctgtgcagtcgtccgcgtccaccttcgtcgtttggctattcacgtgggtccncgaggctccgaggcaagggctgggagtgggngcggtnagtagtgggtaggactggaaagtatgactaaagttttangactacggtaccttccggtaggaacggggccctaaactccaaccattcccgccgaaggcggaccaaggtcccttaaccgaaagtaaccttacctttttancgtacggtactaaacgttaacgaaacgtgacgacacggaacgctacggtctcgtactaagttcgnggtcggcggtacaaggaacggcggttcggggtccgggcctaacggcggacgnggtcggccggtcgg

SEQ ID NO: 321770 - DNA, 711 bp, Homo sapiens
  misc_feature: GZ8MTXP01BI2NN.25.76.G10.1.454.CMB.2.raw
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
  modified_base (403)..(403): a, c, t, g, unknown or other
  misc_feature (403)..(403): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcgttgggttttcctcgttgcttcttttaagaggtgtccagtgtcagatgcaacgtggcggaggtcgggggagcgtggtccaggccggggaatccctgagactctctgtgcagtcgtccgcgtccctaccttccgtcgtttgctattcacgtcgggtcccnccgaggccctccgaggccgaaaggggtacctgggacggtggggtggcggtacagttagnggggtagggaatgggaaagtatggcttaaattttacgngactacgtaccgtcggagggacgggcctactcccactactccgacgaggacgtaccgacgtaccctaaccgtaaacgtaaccctttacctttagccgtacgggaacttaaagttaaccgaaaccgtgaacgtccgtacgaaccgacgtaccggtcttacgttaccgttaacgttccggttgggtacccgggttacggggttaaccgaagggttaaaccggttacccggggttaccggggggttaaccccggtacccggttaaccggtaacggggccgttaacgggtcccgggaacccgggtcccgggg

SEQ ID NO: 321771 - DNA, 729 bp, Homo sapiens
  misc_feature: GZ8MTXP01BYS8X.25.76.G10.1.454.CMB.2.raw
  modified_base (198)..(198): a, c, t, g, unknown or other
  misc_feature (198)..(198): n is a, c, g, or t
  modified_base (290)..(290): a, c, t, g, unknown or other
  misc_feature (290)..(290): n is a, c, g, or t
tcagactgtacagtcacgaccggtgctcgatttagtcactcatacaggggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaangccacgctctcctgcagggccagtcagagtatcggctaggtccttagcctggtatcgacagacgccctggccaggcctcccgaggcctcctnatctatgatgcactccgaacgacgggccacgtcggacccgtcccaagacgtaggttcaggtcggaccgtagggttcggggtcgtggggaactaacggtacctttccgaaccttcctacccgtaaccctagttccgaacgtaccgtaacggttaccgtaacggacggtacccgttaaggtaaagtttaacgtttttagggttaacctttaaggtttttaactttaaccgttacggtaacccgtacggtaccggggtaacggtacgggttaaccggaccgggtaaccgttccggggtaccccgttaccggttaaaccgttaacggttttacggggacccggtaacgggggtacccggtaagggggttcggttacgtttacgaacgttacgtaacgttggttcggcgtgacctaaccgtattcgttcgttccttcgttaacc

SEQ ID NO: 321772 - DNA, 605 bp, Homo sapiens
  misc_feature: GZ8MTXP01DP32C.25.76.G10.1.454.CMB.2.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgttctttgtcctccgaaggggaaanacgccacgctctcctgcagggccagtcagagtatcggcaggtccttagccttggtatcgacagacgcccgtggcccaggcctcccgaggcctccnatctatgatgctataccaacgacgggccacgtcgaccgtcccagactaggttcagtggccaggtggtctagggacaagtcttcacttcaccaccatcagcagtctagacgctagtaagttatttgacttagtttattactgacagacgagtcgtagccgtacgtcgcctacgttaactaacgtttcggaccggtacggggaccgtaagggttacgttacgtttacgaaacgttacgtaacgttgggttcggttccgttaaggaccctaaacccgtttcgttccgttaccgtttaacctttaaccgtcccg

SEQ ID NO: 321773 - DNA, 619 bp, Homo sapiens
  misc_feature: GZ8MTXP01ADK07.25.76.G10.1.454.CMB.2.raw
  modified_base (194)..(194): a, c, t, g, unknown or other
  misc_feature (194)..(194): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccacctgtcttgctccgaggggaaangccacgctctcctgcagggccagtcagagtatcggcaggtcctagcctggtancgacagagccctggccaggcncccaggcctcctcatctatgaatcgacactaccaacgacgggccacgtcgaaccgtccccaggacctagggttcaggtggcccgtaggtggggtctaggggactaagtaccttcactcctacacctatccagcacgtctagagcctagtaagtatttgcttagtttattactgaccagacgagcggtagccgtaacgtcggtcccgtaccgttaactaacgttttcgggacccgtaagggggtacccgtaagggggtacggttaaccgtacttaaacgttacggtaaaccgttggttcgggttacgttaacgaccaaccgtaacgtccgttacgttccgttaacgttcccg

SEQ ID NO: 321774 - DNA, 552 bp, Homo sapiens
  misc_feature: GZ8MTXP01C2YYA.25.76.G10.1.454.CMB.2.raw
  modified_base (276)..(276): a, c, t, g, unknown or other
  misc_feature (276)..(276): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (480)..(480): a, c, t, g, unknown or other
  misc_feature (480)..(480): n is a, c, g, or t
  modified_base (501)..(501): a, c, t, g, unknown or other
  misc_feature (501)..(501): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtggggggtccctgagactctcctgtgtagcctcggattcagcttcagcaaatnagtgtgaactgggtccgcaggctccgaggggaggggctgggaggtgggtcgcagttcgtgagttagtagtagtacttaataaactactacgcagagtcaggtgggagggcccgattcactatctaccagagacaacacaagagacttattttgttcngacaaatgaacnggcctgagagccgagnacggntcgtgtatagttgngtcgagacagtaaagagacgnggttggcgtaggggtccttggacttacgggtcgggggccgtaaaccggggg

SEQ ID NO: 321775 - DNA, 649 bp, Homo sapiens
  misc_feature: GZ8MTXP01AXW7V.25.76.G10.1.454.CMB.2.raw
  modified_base (516)..(516): a, c, t, g, unknown or other
  misc_feature (516)..(516): n is a, c, g, or t
  modified_base (570)..(570): a, c, t, g, unknown or other
  misc_feature (570)..(570): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactgggctccgcttgggttttccttgttgcttattttagaaggtgtcctgtgtgaggtgcaacgtggtggaggtcgtgggggaggccgtggtcagccgtgggggtccctgagactctctgtgtacgcctccggattcagtcttcagactaaatagtagtgtagaacgtcgggtccgccgaggcctaccggaggggacggggtcgtgggaggtgggtcgctagttcggtggagttagtagttagttaacttaataaactactacgacagagtacgaggtgggacgggtccgtacttacactactcctaccgaaagaacgaaaccaaaccgaccgaaaggtcttactttaagttttttcggttaccaggaacctaaaagttcggaaaacncggtaccgtaggaacgacgaccggagacttaccggcttagtagttatttgtggngacgaagtacaaagtaaacgaagacgttggttcgaacgtgggctttacggacgttacgggtcggggaaccgtaaccggg

SEQ ID NO: 321776 - DNA, 767 bp, Homo sapiens
  misc_feature: GZ8MTXP01EFHJC.25.76.G10.1.454.CMB.2.raw
  modified_base (198)..(198): a, c, t, g, unknown or other
  misc_feature (198)..(198): n is a, c, g, or t
tcagactgtacagtcacgaccggtgctcgatttagtcactcatacaggggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaangccacgctctcctgcagggccagtcagagtatcggcaggtccttagcctggtatcgacagacgccctggccacggctcccgaggcctcctcactctaatgatcgacactacccaacgacggggaccctaacgtcggaacccgttccccgaagtacgtaacgggtttcgaaggttcggacccgtaggttggggtcgtacgggggacctaaagggtacctttccgaacttccctaccgaacccctaacttaccgacggtaccctaacgtttacccgttaaaggtaaacgggcccctttaagggtaaaaggtttaacgtttttttagggaccttttaaaggttttaactttaacccgtcggttaccacggttaccggaacgggttacggttaaccggaccggtacggtaccgggttaccccgttaccggttacgttaaacgtttttcggggacccgggttaacgggggccggtaagggggtacggttacggtttaccaaaggttccggtaaacgttgggttcgaccgttcggacctaaccgtacgttcccgtttcttccgtttaacgtaacc

SEQ ID NO: 321777 - DNA, 715 bp, Homo sapiens
  misc_feature: GZ8MTXP01EMH4T.25.76.G10.1.454.CMB.2.raw
  modified_base (197)..(197): a, c, t, g, unknown or other
  misc_feature (197)..(197): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaangccacgctctcctgcagggccagtcagagtatcggctaggtcctagccttggtactcgacagacgcccgtggccaggcctcccgaggcctcctcatctatgatgacactaccgaacgacgggaccctacgtcggaaccccgttcccaaggtaccgtacgggtttaccgaaggttcgggaccccgtagggttcggggtacccgttagggggaaccctaaaggtacctttaacccgaccttacccgtaccaacccctagtacccaaggtacctagtaccgtaggacgtaccgtagtaagttagtttacgtacttagtttacgttactcgacctagacgacggtacgttaacggacgtaaccgtcggtacccgttaccgttaacgttaacggttttccgggaaccggttaacgggggacccggtaaggggttacggttaacgttacgttaaacgttacgtaacgttggttcgggttctcggaccgtaaccgtacgtcgttcgttaaccgttcgttaacccg

SEQ ID NO: 321778 - DNA, 601 bp, Homo sapiens
  misc_feature: GZ8MTXP01EVWPH.25.76.G10.1.454.CMB.2.raw
  modified_base (198)..(198): a, c, t, g, unknown or other
  misc_feature (198)..(198): n is a, c, g, or t
  modified_base (375)..(375): a, c, t, g, unknown or other
  misc_feature (375)..(375): n is a, c, g, or t
tcagactgtacagtcacgaccggtgctcgatttagtcactcatacaggggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaangccacgctctcctgcagggccagtcagagtatcggctaggtccttagcctggtatcgacagacgccctggccaggcctccccgaggcctcctcatctatgatgcatccaacgcgggccacgtgacccgtcccagactaggttcaggtgccgaggtggtctgggacaagcttcactcncactatcagcagtactagacgcgtagtaagttagtttgtacgttagtttacttactcgtacagacgaggtacggtacgcgtacgtcggtcccgttaccgtaacgttacgtttcgggaccggtaacgggggtacccggtaaggggttacggttacgttacgaacgttacggtaacgttggttcggcgtcgaccgtaacctacgttcgttcgttcgttccgtaacccg

SEQ ID NO: 321779 - DNA, 757 bp, Homo sapiens
  misc_feature: GZ8MTXP01BDOHR.25.76.G10.1.454.CMB.2.raw
  modified_base (178)..(178): a, c, t, g, unknown or other
  misc_feature (178)..(178): n is a, c, g, or t
  modified_base (255)..(255): a, c, t, g, unknown or other
  misc_feature (255)..(255): n is a, c, g, or t
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgcttctttaagaggtntccagtgtcagatgcaacgtggcggaggtcggggggagcgtggtccaggccggggaatcccgtgacgactctctgtncagtcgtccgcgtcctacctccgtcgtttggctattcgacgtcgggtccnccaggctccgaggcgaaagggcgtgggacggtggggtacggccggtanagtaggtggggtaggaagttagggaaacttagtggtaccttaaagtttttagcgtacgtaacggtaccgtcccggggtaggaacgggggccctaactacccgacctaacttcccgaccgaaggacgggacctaacggtcctaaaccccgtaaagtaaccttaaccttttaacgccttaggtaccgttaaagtttaaccggaaaaccgttggaaacgtacccgtacggaaaccgaccggtaacggttcgttacgttacccggtaaattttcggcggggtacccgggttacgggggtaaccgtttaaggggaaaacgggttaaccgggccgggggtttccggggaaaccctttcccggggtacggggacgttaccgggttccgggggaaacccggttcccgggggg

SEQ ID NO: 321780 - DNA, 579 bp, Homo sapiens
  misc_feature: GZ8MTXP01CWT2B.25.76.G10.1.454.CMB.2.raw
  modified_base (302)..(302): a, c, t, g, unknown or other
  misc_feature (302)..(302): n is a, c, g, or t
  modified_base (368)..(368): a, c, t, g, unknown or other
  misc_feature (368)..(368): n is a, c, g, or t
  modified_base (426)..(426): a, c, t, g, unknown or other
  misc_feature (426)..(426): n is a, c, g, or t
tcagactgtacagtcacgaccggtgctcgatttagtcactcatacaggggagctctgggagaggagcccagcactagaagtcggcggtgtttccatccggtgatcagcactgaacacagagtactcagcatggagtttgggctgcgcttgggttttcctcgttgcttcttttaagaggtgtccagtgtcagatgcaacgtggcggaggtcgggggaggcgtggtccgaggccggggaatcccgtgagactctcctgtgcagtgtccgcgtccacttccgtcgtttggcattcactgggtccncaggctcgagcaagggctgggagtgggtgcggtcagtagtggtggatgggaagtatgctaattttngcagtctccgtgaacgggccactcactatctcgagagcagctcaagtactacgtttanctggactaagttcgaaaccgtgaacgcacgtaccgacgtcggctcgtcttaagttacgttggcggttccggggtactgggaaacgaccggttacggggttccgggggcccgtaacgttacccggggcgttacgtccggggccgtaacccgggg

SEQ ID NO: 321781 - DNA, 573 bp, Homo sapiens
  misc_feature: GZ8MTXP01AVFJK.25.76.G10.1.454.CMB.2.raw
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
  modified_base (429)..(429): a, c, t, g, unknown or other
  misc_feature (429)..(429): n is a, c, g, or t
  modified_base (442)..(442): a, c, t, g, unknown or other
  misc_feature (442)..(442): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaacgtggtggagtcgtgggggagcctggtcaagccgtgggggtcctgagactctctgtgtacgcctcggattcagcttcagacaaatatagtgtgaactgggtccgccaggctccgaggggaggggctgggagtgggtcgctattcggagagtagtagtagtactataaactactacgcagagtcgagtggaggcctattcatatcncaaganaacaacactaagcgtactatttttgtccngataaagtgaacnggacctaggaagcggaccggagtactacgggtcctagtgttattagttggaancggaaanaacaaagtaaacgagacgttgggttcggcgttggtccttagggacgttacgggccggggaaccgtaacggg

SEQ ID NO: 321782 - DNA, 581 bp, Homo sapiens
  misc_feature: GZ8MTXP02I5GFM.25.76.G10.1.454.CMB.2.raw
  modified_base (196)..(196): a, c, t, g, unknown or other
  misc_feature (196)..(196): n is a, c, g, or t
  modified_base (325)..(325): a, c, t, g, unknown or other
  misc_feature (325)..(325): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaangccacgctctcctgcagggccagtcagagtatcggcaggtccttagcctggtatcgacagagccctggccaggctcccaggcctcctcatctatgatgcatccaacagggccactgaccgtcccagacnggttaacngtgcagtggtcnggacngtactcactcncacatcagcagtctagacgacgtagtaagttagtttgtacgttagtttattactcgtaccgagtacgacgtacgtacgccgtacgtcggtccgtaccgtacgttaacgtttcggaccggtacggggtaccggtacggggtacggtacgttacgtaaacgttacggtacgttcggtcggtcgtcgtccgtaaccgtacgttcgttcgttacctttactacg

SEQ ID NO: 321783 - DNA, 545 bp, Homo sapiens
  misc_feature: GZ8MTXP02JCV8Q.25.76.G10.1.454.CMB.2.raw
  modified_base (196)..(196): a, c, t, g, unknown or other
  misc_feature (196)..(196): n is a, c, g, or t
  modified_base (407)..(407): a, c, t, g, unknown or other
  misc_feature (407)..(407): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaangccacgctctcctgcagggccagtcagagtatcggcaggtccttagcctggtatcgacagagccctggccaggctcccaggctcctcatctatgatgcatccaacaggccatcgacgtcccagacaggttcagtgccagtgggtctggggacagacttcactctcaccatcagcagtctagagcctagaagtatttgactagtttatactnccagcagcgtagcgactcggcctacgtactaacgtttcggaccgtaggggaccgtaggggtcgtacgttacgaaagttaccggtaaacgttggtcggtacgtggcctaaccgtacttccgttcggttccttactaccg

SEQ ID NO: 321784 - DNA, 548 bp, Homo sapiens
  misc_feature: GZ8MTXP02I02NO.25.76.G10.1.454.CMB.2.raw
  modified_base (197)..(197): a, c, t, g, unknown or other
  misc_feature (197)..(197): n is a, c, g, or t
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaanagccacgctctcctgcagggccagtcagagtatcggcaggtccttagcctggtatcgacagacgccctggcccaggcctcccaggcctcctcatctatgatgcatccaacnggccactgaccgtcccagacnggttcagtgccagtggctgggacagacttcactctcaccatcagcagtctagacgctgaagtattttgcttagtttattacgtgacctagcagtcgtagcgtactcggcctccgtactaagttttcggaccgtacggggaccgtaggggtacgtaccgttacgaaacgtcgtaacgttcggtcggtcgtgcctaccgtactcgttcgttcttcgtaccg

SEQ ID NO: 321785 - DNA, 522 bp, Homo sapiens
  misc_feature: GZ8MTXP02GP5ZX.25.76.G10.1.454.CMB.2.raw
  modified_base (197)..(197): a, c, t, g, unknown or other
  misc_feature (197)..(197): n is a, c, g, or t
  modified_base (306)..(306): a, c, t, g, unknown or other
  misc_feature (306)..(306): n is a, c, g, or t
  modified_base (363)..(363): a, c, t, g, unknown or other
  misc_feature (363)..(363): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaanagccacgctctcctgcagggccagtcagagtatcggcaggtccttagcctggtatcgacagagccctggccaggcctcccaggcctcctcatctatgatgcatccaacncggccatgacgtcccagacagtcagtgcagtggctgggacagacttcactctcaccntcagcagtctagagctagaagtatttgactagtttattactgtaccagcagcgtagacgacgtcggccttacgtacgtacgtttcggaccgtaggggaccgaggggtcgtacttacgaactacgtaacgtgtggctcgcacctactcgtcgtcttactc

SEQ ID NO: 321786 - DNA, 614 bp, Homo sapiens
  misc_feature: GZ8MTXP02HNSK4.25.76.G10.1.454.CMB.2.raw
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
  modified_base (380)..(380): a, c, t, g, unknown or other
  misc_feature (380)..(380): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaactggcggaggtcgggggagcgtggtccgaggccggggaatccctgagactctcctgtgcagtgtccgcgtccaccttcgtcgtttgcattcacgtggtccncaggcctcgaggcaaaggggctgggagtggggtcgcggtnatagtggggtgggaatggggaaagttatgtcttaatttttagnggctaagaccgttccggagaacggggcccaacgtccaaccacttccaccgagacggcagcctaccaaagtaacctaccttttatcctagtactaaattacggaaaaccgtgaacgactacggaacgaacgacggtctacgtactttaagtaccgttggccggtcgggggtactaggaaacgtaacgacggggtccggggccgtacgtacgggactacggtcgggaacgcccggg

SEQ ID NO: 321787 - DNA, 534 bp, Homo sapiens
  misc_feature: GZ8MTXP02FSEFR.25.76.G10.1.454.CMB.2.raw
  modified_base (436)..(436): a, c, t, g, unknown or other
  misc_feature (436)..(436): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtctgggggaggcctggtcaagcctgggggtccctgagactctcctgtgtagcctccggattcagcttcagcaaatatagtgtgaactgggtccgccaggctccgagggaaggggctggagtgggtcgcattcgtgagtagtagtagtacttataactactacgcagagtcagtggagggccgattcactatctccagagacaacaccaaagagcatttttgttctgacaaatgaaacngcctgagagccgaggatacggctctgtattattgtgcgagacagtaaagaagacagtaggctaggggcttaggactacggtcggggacctaacggggg

SEQ ID NO: 321788 - DNA, 619 bp, Homo sapiens
  misc_feature: GZ8MTXP02JYCE5.25.76.G10.1.454.CMB.2.raw
  modified_base (199)..(199): a, c, t, g, unknown or other
  misc_feature (199)..(199): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtcctccagcccaccctgtctttgtctccgaggggaaangccacgctctcctgcagggccagtcagagtatcggcaggtccttagcctggtatcgacagacgccctggccaggcctcccgaggcctcctcatctatgatgcatccaacgacgggcccacgtcgaccgtcccagactaggttcaggtggctaggtgggtcgtgggacaggtacttcactctccaccatcagcacgtactagacgctagtaagtagtttagtactaagtttacttacttacgtacgtacgacgacgtacggtacgacgtacgtcggtcccgttacccgttaacgtaacgtttacggtaccggtacgggggaaccggtacggggtacgggtacgttacgtaaacgtacggtaacgtacggtaggtccccccccccccccgtgtaccgaccgactcgttcgttacttctaccg

SEQ ID NO: 321789 - DNA, 500 bp, Homo sapiens
  misc_feature: GZ8MTXP02JG41N.25.76.G10.1.454.CMB.2.raw
  modified_base (196)..(196): a, c, t, g, unknown or other
  misc_feature (196)..(196): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaanagccacgctctcctgcagggccagtcagagtatcggcaggtccttagcctggtatcgacagagccctggccaggctcccaggctcctcatctatgatgcatccaacgaggccactgacgtcccagacaggttcagtgcagtgggtctgggacagacttcactctcaccatcagcagtctagagctgaagtatttgctagtttatactgccagtcagcgtagcgactggcctcgtactaagtttggccgaggggccaaggggttgacttcaaatcgaacgtgnggtcngcacnctctcgtctctc

SEQ ID NO: 321790 - DNA, 535 bp, Homo sapiens
  misc_feature: GZ8MTXP02IGHQQ.25.76.G10.1.454.CMB.2.raw
  modified_base (195)..(195): a, c, t, g, unknown or other
  misc_feature (195)..(195): n is a, c, g, or t
  modified_base (367)..(367): a, c, t, g, unknown or other
  misc_feature (367)..(367): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccacctgtctttgtctccaggggaaangccacgctctcctgcagggccagtcagagtatcggcaggtccttagcctggtatcgacagagccctggccaggcctcccaggctcctcatctatgatgcatccaacaggccactgacgtcccagacaggtcagtggccagtgggtctgggacagcttcactctcaccatcancagtctagagcctagaagtatttgtacttagtttattactgacctagcagtcgtagcgacgtcggtcctcgtactaagtttcggaccgtacggggtaccgtacggggtacggtacgttacgtaaacgtacgtaacgtgtaggtcgtggcaccactctcgttcttctac

SEQ ID NO: 321791 - DNA, 513 bp, Homo sapiens
  misc_feature: GZ8MTXP02GR5PE.25.76.G10.1.454.CMB.2.raw
  modified_base (196)..(196): a, c, t, g, unknown or other
  misc_feature (196)..(196): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaangccacgctctcctgcagggccagtcagagtatcggcaggtccttagccttggtatcgacagagccctggccaggctcccaggcctcctcatctatgatgcatccaacagggccactgaccgtcccagacaggttcagtggccaggtggtctgggacagcttcactctcaccatcagcagtctagagcctgaagtatttagctagtttatactgccagcagcgtagcgactcggcctccgtacgtaagtttcggaccgaggggaccgagggtcggacttcgaatcgaactgtggctgacacgactcgtcgtctactac

SEQ ID NO: 321792 - DNA, 512 bp, Homo sapiens
  misc_feature: GZ8MTXP02JK9CJ.25.76.G10.1.454.CMB.2.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaanagccacgctctcctgcagggccagtcagagtatcggnaggtccttagcctggtatcgacagagccctggccaggctcccaggctcctcatctatgatgcatccaacaggccactgacgtcccagacaggttcagtgccagtggtctgggacagacttcactctcaccatcagcagtctagagcctgaagtatttgctagtttatactgaccagcagcgtagcgatcggcctcgtactaagtttcggccgaggggaccgagggtgggtaccttacaacgtacgtacgtcgtgcgtcgcgactactctcgtcttactc

SEQ ID NO: 321793 - DNA, 577 bp, Homo sapiens
  misc_feature: GZ8MTXP02H0R4Y.25.76.G10.1.454.CMB.2.raw
  modified_base (299)..(299): a, c, t, g, unknown or other
  misc_feature (299)..(299): n is a, c, g, or t
  modified_base (374)..(374): a, c, t, g, unknown or other
  misc_feature (374)..(374): n is a, c, g, or t
  modified_base (406)..(406): a, c, t, g, unknown or other
  misc_feature (406)..(406): n is a, c, g, or t
  modified_base (434)..(434): a, c, t, g, unknown or other
  misc_feature (434)..(434): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagttttgggctgcgctgggttttcctcgttgctcttttaagaggtgtccagtgtcagatgcaactggcggaggtcgggggagcgtggtccagccggggaagtccctgagactctcctgtgcagtgtccgcgtccaccttccgtcgttttggcattcactgggtccnccaggcctccaggcaagggctgggagtggggtggcggtcaagttagtgggtgggatgggaaagtatgctatttangcagacctcgtagaacggggccactcacatcnccagacgcagctacaagacctactttanactgactaagttacgaaaccgtgaagacctacgaccgacgacgtctacgtacttactacgtggccggtacgggttacgtaggaacgtaccggtacggggtcccggggaccgtacgtacggcgttacggcgggtaccgccgggg

SEQ ID NO: 321794 - DNA, 516 bp, Homo sapiens
  misc_feature: GZ8MTXP02IQAAT.25.76.G10.1.454.CMB.2.raw
  modified_base (195)..(195): a, c, t, g, unknown or other
  misc_feature (195)..(195): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccacctgtctttgtctccaggggaaangccacgctctcctgcagggccagtcagagtatcggcaggtccttagcctggtatcgacagagccctggccaggctcccaggcctcctcatctatgatgcatccaacaggccactgaccgtccagacagttcagtggccaggtggtctgggacagacttcactctcaccatcagcagtctagacgctagaagtattttgactagtttattactgtcagcagcgtagcgactcggcctccgtactaacgtttcggaccgaggggaccgtaggggtcggtacttcgaaactcgaacgtgtgctgcactactctcgttcttctac

SEQ ID NO: 321795 - DNA, 674 bp, Homo sapiens
  misc_feature: GZ8MTXP02F2T8N.25.76.G10.1.454.CMB.2.raw
  modified_base (306)..(306): a, c, t, g, unknown or other
  misc_feature (306)..(306): n is a, c, g, or t
  modified_base (388)..(388): a, c, t, g, unknown or other
  misc_feature (388)..(388): n is a, c, g, or t
  modified_base (513)..(513): a, c, t, g, unknown or other
  misc_feature (513)..(513): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagttgggctgcgctgggttttcctcgttgctcttttaagaggtgtccagtgtcagatgcaactggcggaggtcgggggagcgtggtccaggccggggaatccctgagactctcctgttgcagtcgtccgcgtccctaccttccgtcgtttggcatttccacgttcgggtcccnccaggcctccgaggccaagggctgggagtgggtggcgtcagtagtgggtggactagggaagtaatggacttaagtttttagnggacaaggtaccgttcccggtagggaaacgggggcccctaacttcccgaaccctaacttcccgtacccggaaggacgggaccaacggtccctaacccgtaaaagtaaacccttaaccctttttanaccgtagaacctaaagttacgaaaaccgttgaacgtaccgtacggaacgtacaccggtcttacgtacttaacgtttacgcggtccgacggtaggggtctaaggaacggtaacgtaagggggtacccgggaccgttacgaccgggacgtacggtcggaccgg

SEQ ID NO: 321796 - DNA, 597 bp, Homo sapiens
  misc_feature: GZ8MTXP02GY8PM.25.76.G10.1.454.CMB.2.raw
  modified_base (306)..(306): a, c, t, g, unknown or other
  misc_feature (306)..(306): n is a, c, g, or t
  modified_base (377)..(377): a, c, t, g, unknown or other
  misc_feature (377)..(377): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtgggcggaggtcggggggagcgtggtccaggccggggaatccctgagactctcctgtgcaggtcgccgcgtccaccgttccgtcgtttggctattcacgtcgggtcccncaggcctccgaggcgaagggctgggagtggggtggcgtcagtagtgggtggatgggaatagtgctatttangcaggcctcgtgaacggccactcaccntcncagcgcacgctacgaaagtacctacttttancgtanactaagttacgaaaaccgtgaacgtacctacggaacgactacgggtcttaggtaccttaagttacgcggtaccgggtcgggttacagggaaaacggtaccggtacgggggtccggggcctacggtacggctacggtcgggaaccgtcccggggg

SEQ ID NO: 321797 - DNA, 556 bp, Homo sapiens
  misc_feature: GZ8MTXP02I4QRU.25.76.G10.1.454.CMB.2.raw
  modified_base (306)..(306): a, c, t, g, unknown or other
  misc_feature (306)..(306): n is a, c, g, or t
  modified_base (373)..(373): a, c, t, g, unknown or other
  misc_feature (373)..(373): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (483)..(483): a, c, t, g, unknown or other
  misc_feature (483)..(483): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcgtggtccaggccggggaagtccctgagactctcctgtgcagtgtccgcgtcccaccttccgtcgttttggctattcacgtggggtcccnccaggcctccaggcaagggctgggagtgggtggcggtcagtagtggtggatggaagtatgctatttngcagactcgtagacggccactcacatcncagngcagctacaaagactaccttttanctanactaagtacgaaacgtgacgacacgacgacgcgtctacgtactacgtcgnggcggtacgggtactaggaacggtacggtacggggtccgggtaccgtacgtacggctacggtcggaccgccgg

SEQ ID NO: 321798 - DNA, 516 bp, Homo sapiens
  misc_feature: GZ8MTXP02HI29L.25.76.G10.1.454.CMB.2.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaanagccacgctctcctgcagggccagtcagagtatcggcaggtccttagcctggtatcgacagagccctggccaggctcccaggctcctcatctatgatgcatccaacnggccactgacgtccagacaggttcagtggccagtggtctggggacagacttcactctcaccatcagcagtctagacgctagaagtatttgctagtttattactgcagcagtcgtagcgactcggcctaccgtacgtacgtttggaccgtaggggaccgtagggtggtacgttacgaagtcgtacgtgtgacgtgcactactctcgtcttctac

SEQ ID NO: 321799 - DNA, 545 bp, Homo sapiens
  misc_feature: GZ8MTXP02HBAKJ.25.76.G10.1.454.CMB.2.raw
  modified_base (334)..(334): a, c, t, g, unknown or other
  misc_feature (334)..(334): n is a, c, g, or t
  modified_base (426)..(426): a, c, t, g, unknown or other
  misc_feature (426)..(426): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtgggggtccctgagactctcctgtgtagcctccggattcagcttcagcaaatatagtgtgaactgggtccgccaggctccgaggggaggggctggagtgggtcgcattcgngagtagtagtagtacttataaactactacgcagagtcaggtggagggccattcactatctccagagaacaacacaagagactattttgttcngacaaatgaaacagcctagagagccgaaggatacgggctgtgtattagttgtgacgagactaagtaaagaagacaggtcggaactggggcttggacctacgtcgggggacctaacgggg

SEQ ID NO: 321800 - DNA, 565 bp, Homo sapiens
  misc_feature: GZ8MTXP02I2VTE.25.76.G10.1.454.CMB.2.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaangccacgctctcctgcagggccagtcagagtatcggcaggtccttagcctggtatcgacagagccctggccaggcctcccaggctcctnatctatgatgcatccaaacacgggccactcgaccgtcccagacaggttcagtggcctaggtgggtctgggacagacttcgacttctacaccatcagcagtctagacgcctagtaagtatttcgacttagtttaacttacgtcgtaccagacgaagtcgtacgcgtacgtcggccttaccgtactaacgtttcggaccgtacggggaccgtacggggtcggtacgttacgaacgtacgaacgttgtcggctcggactacctacttcgtacttcttacgtacc

SEQ ID NO: 321801 - DNA, 561 bp, Homo sapiens
  misc_feature: GZ8MTXP02G1349.25.76.G10.1.454.CMB.2.raw
  modified_base (293)..(293): a, c, t, g, unknown or other
  misc_feature (293)..(293): n is a, c, g, or t
  modified_base (335)..(335): a, c, t, g, unknown or other
  misc_feature (335)..(335): n is a, c, g, or t
  modified_base (431)..(431): a, c, t, g, unknown or other
  misc_feature (431)..(431): n is a, c, g, or t
  modified_base (494)..(494): a, c, t, g, unknown or other
  misc_feature (494)..(494): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagcctgggggtccctgagactctcctgtgtagcctccggattcagcttcagcaaatatagtgtgaactgggtccncaggcctccgaggggaaggggctggagtggggcgcatttcgngagtagtagtagtacttataaatactacgcagagtcagtgggagggccgattcgattatctccaagagaacaaacaccaaagagctattttgttcngtacaaatgaacagcctgagagccgaggactacggctcgtagttattagtgtgaccggtaaanactaaagtaaacgaacgacgaggtacggcgtagggtacttacgacgtacggtcggggacctaacggg

SEQ ID NO: 321802 - DNA, 752 bp, Homo sapiens
  misc_feature: GZ8MTXP02H8ALM.25.76.G10.1.454.CMB.2.raw
  modified_base (555)..(555): a, c, t, g, unknown or other
  misc_feature (555)..(555): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcggtggtccgaggccggggaacgtcctgagactctcctgtgcaggtcgtcccgcgtccctacccgtttccgttcgttttcggctattccacgtcgggtcccgcgacggcctccgaggaccgaagggcgtggggaggttggggtcggtcggtacagttaggtggggtagggagtagggaaagttatcggtacgtttaatttttagcgtacgtagtacccgttccggtaaggggaaccggggtccctaactacccaaccctacgtttcccgacccgaaagggaccggacctaaccggtacccttaacccgaaaaacgttacccctttaaacccttttttaancccgtttaacggaaactttaaagttaaacccggaaaaccggttgaaccgtaccgtacggaaccgaaacgtccgggtacttacggttacttaacgttccggtacgggtccgggtaccgggggttaacaacgggaaaccggtacgggtaccgggggtcccgggtacgtacggtacggacgtacggtcggaccggtcggg

SEQ ID NO: 321803 - DNA, 583 bp, Homo sapiens
  misc_feature: GZ8MTXP02F02IB.25.76.G10.1.454.CMB.2.raw
  modified_base (197)..(197): a, c, t, g, unknown or other
  misc_feature (197)..(197): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaangccacgctctcctgcagggccagtcagagtatcggcaggtccttagccttggtatcgacagagccctggccaggcctcccaggcctcctcatctatgatgcatccaaacgacgggccacgtgaccgtcccaggacaggttcagtggcctagtgggtctggggacagacttcactctacaccatcagcagtctagagcctagtaagtatttgactagtttactactgacctagcaggcgttagcgacgtcggtccttacggtactaacggttttcggacccgtagggggacccgtagggggttacggtaccgtttacgaaacgttcggaaaccgttgggttcggcgttggaccctaccgtacttccgttacgttccttacttacccg

SEQ ID NO: 321804 - DNA, 522 bp, Homo sapiens
  misc_feature: GZ8MTXP02F508I.25.76.G10.1.454.CMB.2.raw
  modified_base (331)..(331): a, c, t, g, unknown or other
  misc_feature (331)..(331): n is a, c, g, or t
  modified_base (407)..(407): a, c, t, g, unknown or other
  misc_feature (407)..(407): n is a, c, g, or t
  modified_base (458)..(458): a, c, t, g, unknown or other
  misc_feature (458)..(458): n is a, c, g, or t
  modified_base (470)..(470): a, c, t, g, unknown or other
  misc_feature (470)..(470): n is a, c, g, or t
  modified_base (479)..(479): a, c, t, g, unknown or other
  misc_feature (479)..(479): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagcctgggggtccctgagactctcctgtgtagcctccggattcagcttcagcaaatatagtgtgaactggtccgccaggctccgagggaggggctggagtggtcgcagttcgngagtagtagtagtacttataaactactacgcagagtcagtggagggccgattcactatctcagagacaacacaagngctattttgttctgacaaatgaaacagcctgagagaccgaggatacggctntgtattagttgngagagacanaagaagacgagngngtggtcgtcgtacgtacgtcggacgacgg

SEQ ID NO: 321805 - DNA, 597 bp, Homo sapiens
  misc_feature: GZ8MTXP02HZ7TN.25.76.G10.1.454.CMB.2.raw
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
  modified_base (362)..(362): a, c, t, g, unknown or other
  misc_feature (362)..(362): n is a, c, g, or t
  modified_base (457)..(457): a, c, t, g, unknown or other
  misc_feature (457)..(457): n is a, c, g, or t
  modified_base (561)..(561): a, c, t, g, unknown or other
  misc_feature (561)..(561): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagcctgggggtccctgagactctcctgtgtagcctccggattacntctnagactaatatagtgtagacggtcggccncgacgcacggagggacggngaggnggtggcgntagtgagtagtagtagtagtataataactacgacngagtagtacgaggtggggacgggacgtactactactactcctacgaagaacaaacccaaccgaaacgtaaggacctatttttagtttttgtaccnctaaataaagtacgaaacgccgtgtaaggagaccggtacggaagtacgacgtctagttagtttaatcgttgcgaagagaaatagtaaagacgaatggcgtcggnggtactacggacctaggggccggaaccgtaaccggg

SEQ ID NO: 321806 - DNA, 512 bp, Homo sapiens
  misc_feature: GZ8MTXP02FZR6M.25.76.G10.1.454.CMB.2.raw
  modified_base (196)..(196): a, c, t, g, unknown or other
  misc_feature (196)..(196): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaangccacgctctcctgcagggccagtcagagtatcggcaggtccttagcctggtatcgacagagccctggccaggctcccaggctcctcatctatgatgcatccaacagggccactcgaccgtcccagacaggttcaggtggccagtgggtctggggacagacttcactctacaccatcagcagtctagagcctgaagtatttgctagtttatactgcagcagcgtagcgactcgcctcgtactacgtttcggacgacggggacgagggtacggacttacgaatcgaacgtggtggctcgcacgctctcgtcttctac

SEQ ID NO: 321807 - DNA, 539 bp, Homo sapiens
  misc_feature: GZ8MTXP02I1Q1G.25.76.G10.1.454.CMB.2.raw
tcagactgtacagtcacgaccggtgctcgatttagtcactcatacagggggagagaggagccttagccctggattccaaggcctatccacttggtgatcagcactgagcaccgaggattcaccatggaactggggctccgctgggtttccttgttgctattttagaaggtgtcctgtgtgaggtgcaactggtggagtctgggggaggcctggtcaagcctgggggtccctgagactctcctgtgtagcctcggattcagcttcagcaaatatagtgtgaactgggtccgccaggctccgagggaaggggctggagtgggtcgcattcgtgagtagtagtagtacttataaatactacgcagagtcagtgggagggccgattcactatctacagagacaacaccaagagactattttgttactagacaaatgaaacagcctgaacgagacccgaggactacggctcgttagtatttagtgtgacgagacaataaagagacaggtgcgtagggcttgaacctcggtcgggaccgtaacgg

SEQ ID NO: 321808 - DNA, 583 bp, Homo sapiens
  misc_feature: GZ8MTXP02I2ZBS.25.76.G10.1.454.CMB.2.raw
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
  modified_base (374)..(374): a, c, t, g, unknown or other
  misc_feature (374)..(374): n is a, c, g, or t
  modified_base (404)..(404): a, c, t, g, unknown or other
  misc_feature (404)..(404): n is a, c, g, or t
  modified_base (444)..(444): a, c, t, g, unknown or other
  misc_feature (444)..(444): n is a, c, g, or t
  modified_base (524)..(524): a, c, t, g, unknown or other
  misc_feature (524)..(524): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcggggggagcggtggtccaggccggggaatccctgagactctcctgtgcagtgtccgcgtccaccttcgtcgtttggctattcacgtcgggtccncaggcctccaggcaagggctggagtggggtgcgtcagtagngggtaggatggaagtatgactatttacgngacagtacgtcgaggacggcctactcactntccacgaggcgacacgactaacgaaacgtacttactttanactagaacttaaagtacgaaacgtgaacgtacgtacgaacgacgtacgtctagtacttacgtacgtcggacggtcggtanacggaaacggacggacgggtccgggtacctacggacggacgtacggtccggacggtcgg

SEQ ID NO: 321809 - DNA, 777 bp, Homo sapiens
  misc_feature: GZ8MTXP02HMX9C.25.76.G10.1.454.CMB.2.raw
  modified_base (301)..(301): a, c, t, g, unknown or other
  misc_feature (301)..(301): n is a, c, g, or t
  modified_base (385)..(385): a, c, t, g, unknown or other
  misc_feature (385)..(385): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcgtggtccagccggggaagtccctgagactctcctgtgcagtgtccgcgtccaccttccgtcgtttggctattcacgtgggtcccnccaggctccgaggcaagggctgggagtgggtggcggttcagtagtggggtagggatagggaagtaatggtcttaagtttttagngtacgtaacggtaccgtaccgggtagggaaccgggtacccgtaccgtacccgtaacccgtacgttacccgtaaccgaacgggtaccgggaccgtaaccggtacccgttaaacccgtaaaacgttaaacccctttaaccgtttttaacgtaccgtttaacgtaaccgtttaaaacgttaaaccgggtaaaacccggttaggtaaccggtaaccgttaaccggaaaccggtaaccggtaccggttaccgtttacgttaccgtttaaacgttaccggtacggggtaccggggtaaccggggttacgtaacgggaaacggtaaccgggtaccgggggtcccgggtaacccgttaccgggtaccggaccgtacggtaccggggtacccggtccgggg

SEQ ID NO: 321810 - DNA, 528 bp, Homo sapiens
  misc_feature: GZ8MTXP02IG485.25.76.G10.1.454.CMB.2.raw
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (304)..(304): a, c, t, g, unknown or other
  misc_feature (304)..(304): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccacctgtctttgtctccaggggaaangccagctctccngcagggccagtcagagtatcggcaggtccttagcctggtatcgacagacgccctggccaggcctcccgaggctcctcatctatgatgcatccaacgnggccacgtcgaccgtcccagacaggttcagtggccaggtcgggtctggggacagcttcactctcacctatcagcagtcagacgctagaagtatttagtctagtttattactgtcagcgagcgtagcgacgtcgctacgtactagtttcggacgtaggggacgtacgggtagtactacgacgtacgtaacgtcgtcggcgtcgactactactctcgtcttctacg

SEQ ID NO: 321811 - DNA, 540 bp, Homo sapiens
  misc_feature: GZ8MTXP02FSPM5.25.76.G10.1.454.CMB.2.raw
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggcggagtctgggggaggcctggtcaagcctgggggtccctgagactctcctgtgtagcctccggattcagcttcagcaaatatagtgtgaactgggtccgccaggctccgaggggaaggggctggagtgggtcgcattcgtgagtagtagtagtacttataaatactacgcagagtcagtgggagggccgattcatatctcaganacaacacaaganctattttgttcngacaaatgaaacagctgagacgccgaggatacggctcgtgtatttatgtagcgaagactaaataaaggaagaactaggtgcgtggggcttaggaccttacggcgggggaccaaacgggg

SEQ ID NO: 321812 - DNA, 516 bp, Homo sapiens
  misc_feature: GZ8MTXP02FMCWT.25.76.G10.1.454.CMB.2.raw
  modified_base (197)..(197): a, c, t, g, unknown or other
  misc_feature (197)..(197): n is a, c, g, or t
  modified_base (305)..(305): a, c, t, g, unknown or other
  misc_feature (305)..(305): n is a, c, g, or t
  modified_base (370)..(370): a, c, t, g, unknown or other
  misc_feature (370)..(370): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaanagccacgctctcctgcagggccagtcagagtatcggcaggtccttagcctggtatcgacagagccctggccaggctcccaggcctcctcatctatgatgcatcccaanagggccactgaccgtcccagacaggttcagtgccagtgggctggggacagacttcactctcaccntcagcagtctagacgctgaagtatttgactagtttattactgaccagcagcgtagcgactcggccttcgtactaagtttcggaccgaggggaccgagggtcggactttcgaagtcgaacgtcgtggctgcaccatctcgtctctac

SEQ ID NO: 321813 - DNA, 616 bp, Homo sapiens
  misc_feature: GZ8MTXP02HGCQ0.25.76.G10.1.454.CMB.2.raw
  modified_base (359)..(359): a, c, t, g, unknown or other
  misc_feature (359)..(359): n is a, c, g, or t
  modified_base (467)..(467): a, c, t, g, unknown or other
  misc_feature (467)..(467): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcggaggtcggggggagcgtgggtccgaggccggggaagtcccgtgagactctcctgtgcagtcgtccgcgtccctaccgttccgtcgtttggctatttccacgtcgggtcccgccacggcctccgaggcgaaggggctgggaggtggggtggcgtnagtagtgggtggagtggaagtatgactattttgcgacagtacgtccggtaggaacgggcccaactcaccatcctacgagacgcacgcctaccaaagtacctactttancctagactaaattacggaaaccgtgaacgacctacgaacgacgtacggcttagtcttaacgttcgcggtccgggtgggttctaggaaacggacggtagggggtccgggtaccgtacggttaccggacgacgtcggggaccgtcccgggg

SEQ ID NO: 321814 - DNA, 589 bp, Homo sapiens
  misc_feature: GZ8MTXP02HGVF4.25.76.G10.1.454.CMB.2.raw
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
  modified_base (450)..(450): a, c, t, g, unknown or other
  misc_feature (450)..(450): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcgtggtccaggccggggaatccctgagacctctcctgtgcagtcgtccgcgtccaccttccgtcgtttgcattcacgtggtcccncaggctccgaggcaagggactggagtgggtggcgtnagtgtgggtggatggaagtatgactattttagngtcagcgtaccgtgaaagggcccgtacnccacctattccgaccgaggacggcagcctacgaaacgtaacctactttttacnctacgacttaatacgaaacgtgacgtacgtacgacgacgacggtctacgtactagtcgcggtacggtcgggtactacggaaacgtacggtacggggtccgggtaccgtacgtacggacgtacggtccgggaccggtcgg

SEQ ID NO: 321815 - DNA, 580 bp, Homo sapiens
  misc_feature: GZ8MTXP02G2X6I.25.76.G10.1.454.CMB.2.raw
  modified_base (197)..(197): a, c, t, g, unknown or other
  misc_feature (197)..(197): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaanagccacgctctcctgcagggccagtcagagtatcggcaggtccttagcctggtatcgacagagccctggccaggcctcccgaggcctcctcatctatgatgcatccaacacgggccacgtcgaccgtcccagacaggttcaggtggccaggtgggtctgggacaggacttcactctcaccatcagcagtctagacgctagaagtatttgcttaagtttattactgcctagcagcgtagcgtacgtcggtcctaccgtactaacgtttcgggaccggtaacgggggacccgtaaggggtcggtaaccttacgtaaacgttaccggtaaacgttggtcggtcgtaacggtaccaaccgtacttccgtacgtttcctttactaccg

SEQ ID NO: 321816 - DNA, 485 bp, Homo sapiens
  misc_feature: GZ8MTXP02HFPDH.25.76.G10.1.454.CMB.2.raw
  modified_base (196)..(196): a, c, t, g, unknown or other
  misc_feature (196)..(196): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (278)..(279): a, c, t, g, unknown or other
  misc_feature (278)..(279): n is a, c, g, or t
  modified_base (281)..(281): a, c, t, g, unknown or other
  misc_feature (281)..(281): n is a, c, g, or t
  modified_base (283)..(287): a, c, t, g, unknown or other
  misc_feature (283)..(287): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (342)..(343): a, c, t, g, unknown or other
  misc_feature (342)..(343): n is a, c, g, or t
  modified_base (345)..(346): a, c, t, g, unknown or other
  misc_feature (345)..(346): n is a, c, g, or t
  modified_base (348)..(349): a, c, t, g, unknown or other
  misc_feature (348)..(349): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
  modified_base (378)..(379): a, c, t, g, unknown or other
  misc_feature (378)..(379): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaanagccacgctctcctgcagggccagtcagagtatcggcaggtccttagcctggtatcgacngagccccgngcngcncngcncnntnannnnnanacacagcncnacncananagtngngcgngtgngngagagactcnctcncacannannannanancanagtattntatattatatnacannagtagagacgacgtcgtacgtacgtacgtacgttacgtacgacggacggtacggtacgtacgtacgtacgtacgtacgtacgtgcgtcgcactactctctctactc

SEQ ID NO: 321817 - DNA, 549 bp, Homo sapiens
  misc_feature: GZ8MTXP02FOXK6.25.76.G10.1.454.CMB.2.raw
  modified_base (298)..(298): a, c, t, g, unknown or other
  misc_feature (298)..(298): n is a, c, g, or t
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (428)..(428): a, c, t, g, unknown or other
  misc_feature (428)..(428): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgctctttaagaggtgtccagtgtcagatgcaactggcggagtcgggggagcgtggtccaggccggggaagtccctgagactctcctgtgcagtgtccgcgtccaccttccgtcgtttggctattcacgtgggtccnccaggcctccaggcaagggctgggagtggggtggcggtcagtatgggtgggatggaagtaatgctatttangcagactccgtgaagggccatcacatcncagngcagctaccaagaacctaccttttaanctagactaaagttacgaaaaaccgtgaacgactacgacgacacggactgtactattactgcggacgggtctagaaacgacgagggtcggggccgtcgacgggcaacgtcgggacgtccggg

SEQ ID NO: 321818 - DNA, 550 bp, Homo sapiens
  misc_feature: GZ8MTXP02HQVMI.25.76.G10.1.454.CMB.2.raw
  modified_base (176)..(176): a, c, t, g, unknown or other
  misc_feature (176)..(176): n is a, c, g, or t
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (399)..(399): a, c, t, g, unknown or other
  misc_feature (399)..(399): n is a, c, g, or t
  modified_base (415)..(415): a, c, t, g, unknown or other
  misc_feature (415)..(415): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgcttcttttaagnggtgtccagtgtcagatgcaactggcggaggtcggggggagcgtggtccaggccggggaatcctgagactctcctgtgcagtgtccgcgtccacctttccgtcgtttgctattcacgtggtccnccaggctccaggcaagggctggagtgggtggcggtacagtgtggnggatgggaaatatcgntattttancgcagactccgngaacggccactcacatcncaggagcagctacaanaacctactttagtctagactaattacgaaaacctgaacgaccgtcgaacgacacggtctagtactattacgtgcggtgggtactaggaaacgacgacgggtccgggcgtactaccgggatacggcggacgtaccg

SEQ ID NO: 321819 - DNA, 570 bp, Homo sapiens
  misc_feature: GZ8MTXP02FXF1Q.25.76.G10.1.454.CMB.2.raw
  modified_base (196)..(196): a, c, t, g, unknown or other
  misc_feature (196)..(196): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaangccagctctcctgcagggccagtcagagtatcggcaggtccttagccttggtatcgacagacgccctggccaggctcccaggcctcctcatctatgatgcatccaacgagggccacgtcgaccgtccccagacagggttcaggtggccaggtgggtctggggacagacttcactctcaccatcagcagtctagagcctagaagtatttcgactagtttattactgtccagcagcgtagacgactccggctaccgtactaagtttcggaccgtacgggggaccctagggggtcgtacgttacgaaacgttacggtaaacgttggtacggtccgtggaccctaacccgtagttcctttacgttcctttacttaccg

SEQ ID NO: 321820 - DNA, 599 bp, Homo sapiens
  misc_feature: GZ8MTXP02JZSPC.25.76.G10.1.454.CMB.2.raw
  modified_base (345)..(345): a, c, t, g, unknown or other
  misc_feature (345)..(345): n is a, c, g, or t
  modified_base (390)..(390): a, c, t, g, unknown or other
  misc_feature (390)..(390): n is a, c, g, or t
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
  modified_base (530)..(530): a, c, t, g, unknown or other
  misc_feature (530)..(530): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcggggggagcggtggtccaggccggggaagtcccgtgagactctcctgtgcagtcgtccgcgtccaccttccgtcgtttggctagttcacgtcgggtcccgccgaggcctcccgaggccaaggggctgggagtggggnggcggtcagtagtggggtggatggaagtaagtgtactattttagngacacggtactccggtagaacggggccacgtcaacctatccnccgagngcacgctaccaagtaccttacgtttatcgtagactaagtacgaaaaccgtgaacgtacgtacgacgacgacggtcttagtactacgttacgnggccggtacgggtactagaacggtacgacgggtccgggccgttacgcggacgacggtcggaccgccggg

SEQ ID NO: 321821 - DNA, 603 bp, Homo sapiens
  misc_feature: GZ8MTXP02GS691.25.76.G10.1.454.CMB.2.raw
  modified_base (306)..(306): a, c, t, g, unknown or other
  misc_feature (306)..(306): n is a, c, g, or t
  modified_base (376)..(376): a, c, t, g, unknown or other
  misc_feature (376)..(376): n is a, c, g, or t
  modified_base (405)..(405): a, c, t, g, unknown or other
  misc_feature (405)..(405): n is a, c, g, or t
  modified_base (434)..(434): a, c, t, g, unknown or other
  misc_feature (434)..(434): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaactggcggaggtcggggggagcgtggtccaggccggggaagtccctgagactctcctgtgcagtcgtccgcgtccctaccttccgtcgtttggctattcacgtgggtcccncaggctccgaggcaagggctggagtggggtggcggtcagtagtgggtggagtggaagtatgctattttangcagctcgtagaacgggccactcacatcncagcgacagctacgaaagtactcctttancctgactaagttacgaaaaccgtgaacgtaccgtacgaacgacacggcttagtaccttaagttaccgtggtaccggtaccgggggttaacaacggaaaaccggaacgggtacgggggtcccgggtaccggtacggtaccggacgtaacggtaccgggaccggtccgggg

SEQ ID NO: 321822 - DNA, 713 bp, Homo sapiens
  misc_feature: GZ8MTXP02HZL2O.25.76.G10.1.454.CMB.2.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaanagccacgctctcctgcagggccagtcagagtatcggcaggtccttagcctggtatcgacagggcctcggcgacgcgtccctacggcgtcctccatactacttaggntagtcgactacctaaccgaaacggggacccggacctacggtacccggtaccccgtaccgaaacggtacggttggtaccggtaggggtcgacccggtaggggttccgttacggggacggacgtacgtttctcctaccttccacccgaaactctacgactacgtaccgttagaacggccttacggtaaggtaaagtttttcgttacgtaagttttaatttaaccttgacccgagtacacgtacggtacgtaccggacgttagtccccgttaccgttaacgttacgttttaacgggttcccggaacgggggtaccggggtaaccggttagggggtacctttacgtaaccgtaacggttaaaccttgggtcggcccgtagtccgaccctagtcttcggtctttacctacttcccg

SEQ ID NO: 321823 - DNA, 575 bp, Homo sapiens
  misc_feature: GZ8MTXP02JO4RA.25.76.G10.1.454.CMB.2.raw
  modified_base (298)..(298): a, c, t, g, unknown or other
  misc_feature (298)..(298): n is a, c, g, or t
  modified_base (370)..(370): a, c, t, g, unknown or other
  misc_feature (370)..(370): n is a, c, g, or t
  modified_base (406)..(406): a, c, t, g, unknown or other
  misc_feature (406)..(406): n is a, c, g, or t
  modified_base (430)..(430): a, c, t, g, unknown or other
  misc_feature (430)..(430): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggagcgtggtccagccggggaagtccctgagactctcctgtgcagtgtccgcgtccaccttccgtcgtttggcattcactgggtcccnccaggctcccaggcaagggctggacgtggggtggcggtcagtagtggtgggatgggaagtatgctatttagngacagcgtcgaggacggccactcacactccacgagngcacgactacgaactactactttnactagactaagtacgaacgtagacgtacgtacgacgacacgtactgtacttacttacgtggaccggtcggggtacgtacggaaacggtacggtacgggggtccgggaccgtacggaccggacgtacggtacggggaccggtccgg

SEQ ID NO: 321824 - DNA, 508 bp, Homo sapiens
  misc_feature: GZ8MTXP02GQUDP.25.76.G10.1.454.CMB.2.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (300)..(300): a, c, t, g, unknown or other
  misc_feature (300)..(300): n is a, c, g, or t
  modified_base (347)..(347): a, c, t, g, unknown or other
  misc_feature (347)..(347): n is a, c, g, or t
  modified_base (502)..(502): a, c, t, g, unknown or other
  misc_feature (502)..(502): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaangccagctctcctgcagggccagtcagagtatcggcaggtccttagcctggtatcgacngagccctggccaggctcccaggctcctcatctatgatgcatccaanggccacgtgaccgtcccagacaggttcagtggcagtggtctgggacngacttcactctcaccatcagcagtctagagctagaagtatttgctagtttatactgacctagcagcgtagcgtatcggcctccgtactaagtttggaccgtaggggtaccgaggggttcgacttacgaaatcgaactgtggctgcaccatccttntctctc

SEQ ID NO: 321825 - DNA, 596 bp, Homo sapiens
  misc_feature: GZ8MTXP02IZ5PA.25.76.G10.1.454.CMB.2.raw
  modified_base (197)..(197): a, c, t, g, unknown or other
  misc_feature (197)..(197): n is a, c, g, or t
  modified_base (384)..(384): a, c, t, g, unknown or other
  misc_feature (384)..(384): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaanagccacgctctcctgcagggccagtcagagtatcggcaggtccttagcctggtatcgacagagccctggccaggcctcccaggcctcctcatctatgatgcatccaacgacgggcccacgtcgaccgtcccagactaggttcaggtggcctaggtgggtctagggacagtacttcactctcaacctntcagcagtcgtagacgacgtagtaagttagtttcgtagttagtttacttactcgtacagacgacgtacgtacgcgacgtcgtaccttaccgtacgttacgtttcggaccggtaacggggtacggtacggggtacgtacgttacgtaaacgtacgtaacgtcggtacggtacgtaacgacctaccgtacgttcgttacgttaccttactaccg

SEQ ID NO: 321826 - DNA, 672 bp, Homo sapiens
  misc_feature: GZ8MTXP02HNLJ7.25.76.G10.1.454.CMB.2.raw
  modified_base (443)..(443): a, c, t, g, unknown or other
  misc_feature (443)..(443): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgcttattttagaaggtgtcctgtgtgaggtgcaatggtggagtcgtgggggaggcctggtcaaggccgtgggggtccctgagactctcctgtgtagcctcggattcagcttcagacaaatatagtgtagaacgtcgggtccgccgaggcctaccggaaggggaaggggcgtagggaggtgggtcgctaagtttcggtaggtaagttaggtaagttaagtaacttaaataaaataacctaacggacaaggagtacgagggtggggaacggggcctatttacaacttancctaccaaagaagaaacccaaacaaccgtaaagcgtacttagtttttcgttacgagactaaaaagttgaaaaccgtagccttaaggaacgacgggaccgaagggtaacttaccgggccttgttaagttaactttaggtacggtacgacgtaagaacaaagtaaagaaacgaacgaaggtacggtaacggtacggtacgtacgtacgtacggtacgggtaccggaaccgg

SEQ ID NO: 321827 - DNA, 649 bp, Homo sapiens
  misc_feature: GZ8MTXP02JBQUA.25.76.G10.1.454.CMB.2.raw
  modified_base (303)..(303): a, c, t, g, unknown or other
  misc_feature (303)..(303): n is a, c, g, or t
  modified_base (574)..(574): a, c, t, g, unknown or other
  misc_feature (574)..(574): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaactggcggaggtcgggggagcgtggtccaggccggggaagtccctgagactctcctgtgcagtcgtccgcgtccaccttcgttcgtttggctattcactgggtcccncaggctccgaggcaagggctgggacgtggggtggcggtcagtagtggggtagggatagggaaagttaatcggtactaatttttagcggtacaacggtaccgttcccggtagggaaacggggtcccgacttccgaaccctagttcccaccgaaggacggaccaggcccttaacccgaaagtaaccttacctttttaagccttaggacctaaagtttacggaaaaccgttgaacgacctacggacgtacacggtctgtaccttagttaccggnggccggtaggtacacggaaacggtacggtacggggtccggtccgtacggtacggacgacggtacggaccggtcgg

SEQ ID NO: 321828 - DNA, 657 bp, Homo sapiens
  misc_feature: GZ8MTXP02IYNW1.25.76.G10.1.454.CMB.2.raw
tcagactgtacagtcacgaccggtgctcgatttagtcactcatacagggggagagaggagccttagccctggattccaaggcctatccacttggtgatcagcactgagcaccgaggattcaccatggaactgggctccgctgggtttcctgttgctatttagaaggtgtcctgtgtgaggtgcaactggtggagtcgtgggggaggcctggtcaagccgtggggggtccctgagactctcctgtgtagcctccggattcagcttcagcaaatatagtgtgaactgggtccgccaggcctccgaggggaaggggctggaggtgggtcgcagttcgtgagtagtagtagtaacttaataaactactacgcagagtcagtggggacgggccgagttcaacttatcctacccaagaacgaaccaaaccaaccgtaaagacgcttaagtttttcggttctaggactaaaagttcggaaaaccacgtacccgtaggaacgaacgggaccccgaaagggtacgttaaacggggcctttaacgttaggtttaaattagttttggacggacgtaaaggaacaaagttaaaaggaaacgaacgtgggttacggcgttgggggactttacggaacgttaaccggtcggggggaaccctaaaccggggg

SEQ ID NO: 321829 - DNA, 540 bp, Homo sapiens
  misc_feature: GZ8MTXP02JIZIR.25.76.G10.1.454.CMB.2.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaanagccacgctctcctgcagggccagtcagagtatcggcaggtccttagcctggtatcgacagagccctggccaggctcccaggctcctcatctatgatgcatccaanaggccactgaccgtccagacaggttcagtgcctagtggctgggacagcttcactctcaccntcagcagtctagacgctagaagtatttgctagtttattactgtaccagtcagtcgtagcgacgtcggcctaccgttacgtacgtttcggaccgtacggggaccgtaggggtacggacgttacgaaacgtacgtaacgtcggtcggtcgtcgcctacgtactcgttcgtcttctaccg

SEQ ID NO: 321830 - DNA, 641 bp, Homo sapiens
  misc_feature: GZ8MTXP02G9YMV.25.76.G10.1.454.CMB.2.raw
  modified_base (390)..(390): a, c, t, g, unknown or other
  misc_feature (390)..(390): n is a, c, g, or t
  modified_base (522)..(522): a, c, t, g, unknown or other
  misc_feature (522)..(522): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtggcggaggtcgggggagcgtggtccgaggccggggaagtccctgagacctctccgtgtcgcagtcgccgcgtcccaccttccgtcgtttggctattccgacgtcgggtcccgccaggcctccgaggcaagggctgggaggtgggtggcggtcagtgtggggtggagtgggaagtagtgtacttattttagngactagccgttaccgggtagggaaacgggcccgaacttcaccgtactccgtacgaggacgcacgcctaccaaagtaccttacctttagctgaactaagttacgaaaaccgtgacgtacctacggacaaccgnggtaccttggttacttaaacttccggcggacgggtacggggtctagggtaaaaccgcggtaacggggtccgggacccgttacggaaccggtcgtaacggtccggggaacccgtccgggg

SEQ ID NO: 321831 - DNA, 628 bp, Homo sapiens
  misc_feature: GZ8MTXP02HU4J6.25.76.G10.1.454.CMB.2.raw
  modified_base (195)..(195): a, c, t, g, unknown or other
  misc_feature (195)..(195): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaanagccacgctctcctgcagggccagtcagagtatcggcaggtccttagccttggtatcgacagcgcccctggccaggcctccccaggcctcctcatctatgatgcatacccaagcggccactcgaccgtcccagtacaggttcaggtggcctaggtcgggtctggggacaggtacttcactcctacaccgtatcgagcctagtctaggacgtcctagtaagttattttagcgttaagttttacttacgtcgtacccgtagacgtaacggtcgttaacggccggtaaccgtccgggtacccgttacccgttaacgttacgttttacgggaccgtaacgggggaccggtacgggggttacggtaccgttacgtaacgttaccggtaacgtggttacggcgtaacggccaaccgtactcgttcgttcctttactccg

SEQ ID NO: 321832 - DNA, 578 bp, Homo sapiens
  misc_feature: GZ8MTXP02JFIUR.25.76.G10.1.454.CMB.2.raw
  modified_base (308)..(308): a, c, t, g, unknown or other
  misc_feature (308)..(308): n is a, c, g, or t
  modified_base (384)..(384): a, c, t, g, unknown or other
  misc_feature (384)..(384): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (465)..(465): a, c, t, g, unknown or other
  misc_feature (465)..(465): n is a, c, g, or t
  modified_base (502)..(502): a, c, t, g, unknown or other
  misc_feature (502)..(502): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcggggggaggcggtggtccaggccggggaagtccctgagactctcctgtgcagtcgtccgcgtcccaccttccgtcgtttggctattcacgtcgggtcccnccgaggcctccgaggcaaggggctggggaggtggggtggcggtcagtgtgggtggatggaaagtatgctattttangcagacgtccgagaacgggccactcacatcnccaggngcacgctaccaagaccttctttanctanactaagtacgaaacgngaacgtacgacgacgacgacgtctcgtactacgtcgnggccggtcgggtactacggaacggtacggcggggtccgggtccgtacggacgggctacggtccgggaccgtccggg

SEQ ID NO: 321833 - DNA, 569 bp, Homo sapiens
  misc_feature: GZ8MTXP02J3SKJ.25.76.G10.1.454.CMB.2.raw
  modified_base (344)..(344): a, c, t, g, unknown or other
  misc_feature (344)..(344): n is a, c, g, or t
  modified_base (409)..(409): a, c, t, g, unknown or other
  misc_feature (409)..(409): n is a, c, g, or t
  modified_base (430)..(430): a, c, t, g, unknown or other
  misc_feature (430)..(430): n is a, c, g, or t
  modified_base (487)..(487): a, c, t, g, unknown or other
  misc_feature (487)..(487): n is a, c, g, or t
  modified_base (528)..(528): a, c, t, g, unknown or other
  misc_feature (528)..(528): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctgggtcaaggccgtggggggtccctgagactctcctgtgtagcctccggattcagcttcagcaaatatagtgtgaacgtgggtccgccgaggctccggaggggaaggggctgggaggtgggtcgctattcgngtagtagtagtagtacttaataaactactacgcagagtcaggtggggagggcctattcactatcnccagaacgacaaacaccaagngctatttcgttactgactaaatcgaaactgcctagagacggccgagacgtacggctnttgttattagtgtgacgagacaagtaagacgacgaggtggngtcggggtcttacgaccgttacggcggggacctaaccgggg

SEQ ID NO: 321834 - DNA, 762 bp, Homo sapiens
  misc_feature: GZ8MTXP02JQQUO.25.76.G10.1.454.CMB.2.raw
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcggtggtccgaggccggggaagtcccctgagactctcctgtgcagtcgtccgcgtccaccttccgtcgtttggctattccacgtcggtcccgccaggcctccgaggcaaggggctggggagtggggtggcggtcagttagtggggtaggagtaggggaacgtaatcggacttaatttttagcgtacaggtacccgttacccgggtagggaaaccggggtcccgtaacctccaaccctaacgtcccgtacccgaaggacgggacaacggacccttaaccccgaaaggtaaaccccttaaccgtttttaaactcccgtaggtaaccctaaagtttaaccggaaaaacccggtttaggaaaccgacgttaccggaaccgtaaccgtaacgggtccttacggtacctttactttacggtcggtacccggggtaccgggggttacgttaaccggggaaaacggtaaaccgggtaccggggtaacccgggggtaccccgtaacgggttaaccggggccgtaacgggttccgggggaacccggtacccggggg

SEQ ID NO: 321835 - DNA, 684 bp, Homo sapiens
  misc_feature: GZ8MTXP02JBZ26.25.76.G10.1.454.CMB.2.raw
  modified_base (260)..(260): a, c, t, g, unknown or other
  misc_feature (260)..(260): n is a, c, g, or t
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
  modified_base (389)..(389): a, c, t, g, unknown or other
  misc_feature (389)..(389): n is a, c, g, or t
  modified_base (509)..(509): a, c, t, g, unknown or other
  misc_feature (509)..(509): n is a, c, g, or t
  modified_base (579)..(579): a, c, t, g, unknown or other
  misc_feature (579)..(579): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtggcggaggtcggggggaggcggtggtccgaggccggggaagtccctgagctctcctgtgcngtcgtccgcgtcccaccttccgtcgtttggctattcacgtgggtcccnccgaggcctccgaggcgaaggcgtgggaggtggggtggcgtnagtagtggggtggatagggaaagtatgtacttattttangactaacggtaccgttaccggtaagggaaccggggtccctaacgttacccgaaccctagttcccacccgaagggacggtaccacggtaccctaaccgaaaacgtaacccttaccttttanccgtagtactaaagttacgaaaaccgtgaacgtacctcgaacgacgtacggtctacgtacttacgtacgngggaccggtcggggttacaacgggaaacggaaccggtacgggggtcccgggggtaacccgtccggtaaaccggggctaacgggtaccgggacggtaccccggggg

SEQ ID NO: 321836 - DNA, 586 bp, Homo sapiens
  misc_feature: GZ8MTXP02GEOBA.25.76.G10.1.454.CMB.2.raw
  modified_base (196)..(196): a, c, t, g, unknown or other
  misc_feature (196)..(196): n is a, c, g, or t
  modified_base (381)..(381): a, c, t, g, unknown or other
  misc_feature (381)..(381): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaanagccacgctctcctgcagggccagtcagagtatcggcaggtccttagcctggtatcgacagacgccctggccaggcctcccgaggcctcctcatctatgatgcatcccaaacgcgggccacgtcgaccgtcccagacaggttcaggtggcctaggtggtctggggacagtacttcactctcaccntcagcagtctagacgtacctagaagttatttgtacttaagtttacttacgtcgacctagcgacggtcgtacgcgtacgtcggtcctacgttacgttaacgtttcggaccggtacggggaccgtaggggtcgtacgttacgaaacgtacggtaacgttcggtcggacgtcggaccgtaactacgttcgttcgttcctttactaccg

SEQ ID NO: 321837 - DNA, 674 bp, Homo sapiens
  misc_feature: GZ8MTXP02JY4D8.25.76.G10.1.454.CMB.2.raw
tcagactgtacagtcacgaccggtgctcgatttagtcactcatacagggggagagaggagccttagccctggattccaatgcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtgggggtccctgagactctcctgtgtagcctcggattcagcttcagacaaatagtagtgtagaacgtgggtcccgcgaggctccgaggggaaggggcgtggaggtgggtcgctagttcgtgagtagtagtagtacttaataaatactacacgagagtcgagggtggggacggggtacccgtagttccaacttactacccgtacccgaaagggaaccaaaccctaaaaccaacccgaaaaggacgttacctttaagttttttcgtttaccgaggtaaacctaaaagttacgaaaccgtacggacccgttaagggacgggacgtacccggagggtacgtaccggtctgttagttattacgtggtacgacggaaacgtaaacaaagtaaacgaacgtacgtaggtcggtcggttacggtacgttacggtaccggtacggggaccgggtaacccg

SEQ ID NO: 321838 - DNA, 576 bp, Homo sapiens
  misc_feature: GZ8MTXP02FVKAU.25.76.G10.1.454.CMB.2.raw
  modified_base (196)..(196): a, c, t, g, unknown or other
  misc_feature (196)..(196): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccaggggaaanagccacgctctcctgcagggccagtcagagtatcggcaggtccttagcctggtatcgacagacgccctggccaggcctcccgaggcctcctcatctatgatgcatccaacgaggccactgaccgtcccagacaggttcagtggcaggtgggtctgggacagtacttcactcncaccntcagcagtctagagctagaagtatttgtacttagtttattacgtgaccgagtcgagcgtacgcggtacgtcggtcccgttaccgtacgttaacgtttcgggaccgtagggggtacccgtaggggttacggtacttacgaaacgttcggtaacgtggtacggtcgtcggacctaccgtacgttccgttacgttccttactaccg

SEQ ID NO: 321839 - DNA, 656 bp, Homo sapiens
  misc_feature: GZ8MTXP02GYFMA.25.76.G10.1.454.CMB.2.raw
  modified_base (195)..(195): a, c, t, g, unknown or other
  misc_feature (195)..(195): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccacctgtctttgtctccaggggaaangccacgctctcctgcagggccagtcagagtatcggcaggtccttagcctggtatcgacagacgccctgggccaggcctccccgaggtcctcctcatctatgatcgacactaccaaacgagggccaacgtcggaacccgttccccaaggaccctaaggggtttccaagggttcggacccgaggggtttcggggtcctagggggaacctaggtaacctttcaaccttctaccaaccgtatccgagtcgacgtacgtacgacgtaccgtagtaagttaattttcggtacttagttttacttacgttacgacctagacgacggtacgttagccggtacgtcggtcccgttaccgtacgttacgtttcgggaccggtacggggaccggtaggggtacggtacgttacgtaagtacgtaacgtcggtacgtcgtcgaccgtacctactcttcgttccttacttcccg

SEQ ID NO: 321840 - DNA, 652 bp, Homo sapiens
  misc_feature: GZ8MTXP02IA03D.25.76.G10.1.454.CMB.2.raw
  modified_base (309)..(309): a, c, t, g, unknown or other
  misc_feature (309)..(309): n is a, c, g, or t
  modified_base (494)..(494): a, c, t, g, unknown or other
  misc_feature (494)..(494): n is a, c, g, or t
  modified_base (569)..(569): a, c, t, g, unknown or other
  misc_feature (569)..(569): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgtttgcttcttttaagaggtgtccagtgtcagatgcaacgtgggcggaggtcgggggagcgtggtccaggccggggaatccctgagctctcctgtgcagtcgtccgcgtccaccttccgttcgtttggctattccacgtcgggtccccncgaggcctccgaggcaagggctgggaggtggggtggcgtcagtaggtgggtagggattagggaaagttaacgtgtacttagttttaacgcgtacaggtaccgttccggtaggaaacgggggccctacgtacccactactccgtaccgaggacggcacggactaccgaaagtaacttacgttttancctagtacctaaattaccggaaaaccgtgaaccgaccgtacgaacgacgacggtcttacgtcttaaacgttccgnggtccgggtaccgggtactacgaaaccggaccggtaggggccggggtcccgttacgaccggtacaggtaccggaccgtccggg

SEQ ID NO: 321841 - DNA, 657 bp, Homo sapiens
  misc_feature: GZ8MTXP02HMIUQ.25.76.G10.1.454.CMB.2.raw
  modified_base (324)..(324): a, c, t, g, unknown or other
  misc_feature (324)..(324): n is a, c, g, or t
  modified_base (529)..(529): a, c, t, g, unknown or other
  misc_feature (529)..(529): n is a, c, g, or t
  modified_base (576)..(576): a, c, t, g, unknown or other
  misc_feature (576)..(576): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggagcggtggtccgaggccggggaatcccgtgacgacctctccgtgtcgctaggtcgtcccgcgtcccaccgtttccgttcgtttggactatttccacgttcgggtccccnccgaggtcctccgaggcgaaagggactggggaggtggggtggcggtcaagttggtggggtggacgtagggaagttaactggtacttagtttttagcggaccgtaaagtacccgttaccggtagggaacggggtcccgtaacctacccgaacctacgtcccgacgaggacggcacgtacctaccgaaagtacccttacgttttacnctacgtaacttaacgtaacgaacgtgacgaccgacgaccgacgcgtntcgtacgtactcgtcggcggtcggtactacggaacgtacggcggggtccggtacgtacgtacggcgtacggcggaccgcgg

SEQ ID NO: 321842 - DNA, 649 bp, Homo sapiens
  misc_feature: GZ8MTXP02HF2Y2.25.76.G10.1.454.CMB.2.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaanagccacgctctcctgcagggccagtcagagtatcggnaggtccttagcctggtatcgacagacgcccgtggccaggcctcccgaggcctccctcatctatggatcgacactaccaaacgacggacctacgtcggacccgtacccagactaggttcaggtggacccgtaggttgggtaccgtggggactaggtaccttcaaccttcaccacctatcgagtacgagtacgtagacgcgtagaacgtttagtttagacgttagtttaattacgtgtaccagtacgtacggtacgtacgtacggtaccgttcggacccttaccggtaacgttaacggttttcggaccgggtacggggacccggtaggggttaccggtaacgttacgtaaacgtacggtaacgttcggtacggtacgtcggtacccacgttacgtcgtttcgtacctttactacccg

SEQ ID NO: 321843 - DNA, 644 bp, Homo sapiens
  misc_feature: GZ8MTXP02J279W.25.76.G10.1.454.CMB.2.raw
  modified_base (177)..(177): a, c, t, g, unknown or other
  misc_feature (177)..(177): n is a, c, g, or t
  modified_base (253)..(253): a, c, t, g, unknown or other
  misc_feature (253)..(253): n is a, c, g, or t
  modified_base (263)..(263): a, c, t, g, unknown or other
  misc_feature (263)..(263): n is a, c, g, or t
  modified_base (305)..(305): a, c, t, g, unknown or other
  misc_feature (305)..(305): n is a, c, g, or t
  modified_base (357)..(357): a, c, t, g, unknown or other
  misc_feature (357)..(357): n is a, c, g, or t
  modified_base (515)..(515): a, c, t, g, unknown or other
  misc_feature (515)..(515): n is a, c, g, or t
  modified_base (544)..(544): a, c, t, g, unknown or other
  misc_feature (544)..(544): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgtcttgggttttcctcgttgcttcttttaagnggtgtccagtgtcagatgcaacgtggcggaggtcgggggagcgtggtccaggccgggaatcctgagactctctgtncagtcgtccncgtcctaccttcgtcgtttggctattccgacgtcgggtcccncgaggtcctcgaggcaaaggggtctgggacgtggggtcggcggtcagttagngggtaggatagggtaaatagtgtacttaagttttgcgactaaacgtccgtccggtagggaaacccgggtcctactcccgaaaccctatcccgtacgaagggagccaagaccctacgaaaacgtaccttactttagcctgaactaagttacgaaacgtnacgacctacgacgacgacggtctacggtnttaactccggtggcccgggtacggttacacgggaaaacgtaccgggtacggggtcccggggtactaccggacggtccacggttaccggaccggtcccggg

SEQ ID NO: 321844 - DNA, 597 bp, Homo sapiens
  misc_feature: GZ8MTXP02HB5YI.25.76.G10.1.454.CMB.2.raw
  modified_base (176)..(176): a, c, t, g, unknown or other
  misc_feature (176)..(176): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
  modified_base (380)..(380): a, c, t, g, unknown or other
  misc_feature (380)..(380): n is a, c, g, or t
  modified_base (415)..(415): a, c, t, g, unknown or other
  misc_feature (415)..(415): n is a, c, g, or t
  modified_base (448)..(448): a, c, t, g, unknown or other
  misc_feature (448)..(448): n is a, c, g, or t
  modified_base (469)..(469): a, c, t, g, unknown or other
  misc_feature (469)..(469): n is a, c, g, or t
  modified_base (513)..(513): a, c, t, g, unknown or other
  misc_feature (513)..(513): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgcttcttttaagnggtgtccagtgtcagatgcaactgggcgggaggtcggggggagcgtggtccaggccggggaatccctgacgactctcctgtgcagtcgtccgcgtccaccttccgtgtttggctattccacgtgggtcccnccnggcctccgaggcaagggctggagtgggnggcggtcagttgngggtaggatggaatatggacttattttanggactagtaccgtcgtaggacggccgactcgaccntcacagacgcacgcaccaagaccttactttacnctagactaagttacgaaacgngaacgaccgtacgaacgacgacgtcttagtaccttacgttccgnggaccgggtacgggtacgaacggaaacggtaccggtacggggtccgggtccgtacggtacggcgtacggtccggacccggtcgg

SEQ ID NO: 321845 - DNA, 521 bp, Homo sapiens
  misc_feature: GZ8MTXP02HNMJ4.25.76.G10.1.454.CMB.2.raw
  modified_base (193)..(193): a, c, t, g, unknown or other
  misc_feature (193)..(193): n is a, c, g, or t
  modified_base (251)..(251): a, c, t, g, unknown or other
  misc_feature (251)..(251): n is a, c, g, or t
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccacctgtcttgtctcaggggaaangccacgctctcctgcagggccagtcagagtatcggcaggtccttagcctggtatcganagagccctggccaggctcccaggctccncatctatgatgcatccaanggccactgactccagacagttcagtgccagtgggtctggggacagacttcactctcaccatcaagcagtctaggagcctagtaacgtattttcggacttagtttattacgtgacagcagtcgtagcgactcggcctacgtactagtttcggacgtagggccgtagggtcgtacgtacgaacgtactacgtgtcggtcgtaagacactacgtctctcttactcc

SEQ ID NO: 321846 - DNA, 568 bp, Homo sapiens
  misc_feature: GZ8MTXP02HK4QJ.25.76.G10.1.454.CMB.2.raw
  modified_base (197)..(197): a, c, t, g, unknown or other
  misc_feature (197)..(197): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaangccacgctctcctgcagggccagtcagagtatcggcaggtccttagcctggtatcgacagagccctggccaggcctcccgaggcctcctcatctatgatgcatccaacgacgggcccactgacccgtcccagactaggttcaggtggccgaggtgggtctggggacagacttcactctacaccatcagcagtctagacgctagaagtatttgactagtttatactgacctagcagcgtacgcgacgtcggcccttacgtaactaacgtttcggaccgaacgggggtacccgtaggggtacgtaccgttacgtaaacgtacggtaaacgtggtacggtctcggacaccgtacttcgttcgtccttactaccg

SEQ ID NO: 321847 - DNA, 635 bp, Homo sapiens
  misc_feature: GZ8MTXP02GMWQC.25.76.G10.1.454.CMB.2.raw
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaaggccgtggggggtccctgagactctcctgtgtagcctcggattcagcttcagcaaatatagtgtgaacgtgggtcccgccaggctccgagggaaggggctggaggtggcgcagttcgtgagtagtagtagtacttaataaatactacgcagagtcaggtggggacgggccgtagttcaactatctaccaagacgaaacaacaaccaaggagtacttagtttttacgttctagtactaaaattacggaaaaccacggtaccctaggaaacggacgggcccgaaaggtagtaccggccttctaggtttaatttagttgtacggacgaagaaacctaaagtaaaacggaaagacgtagggttacggcgtcgggggtactttacggaaccgtttacggcgggggaccctaaaaccggggg

SEQ ID NO: 321848 - DNA, 693 bp, Homo sapiens
  misc_feature: GZ8MTXP02F46XT.25.76.G10.1.454.CMB.2.raw
  modified_base (197)..(197): a, c, t, g, unknown or other
  misc_feature (197)..(197): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggcgaaattgtgttgacacagtctccagccaccctgtctttgtctccgaggggaaanagccacgctctcctgcagggccagtcagagtactcggcaggtccttagcctggtatcgacagacgcccctggccaggcctccgaggcctcctcatctatgatgcatacccaacgcggccctacgtcgacccgtacccaggtaccgtaggttcgaaggtcggaccgtagggtcggggtacgtaggggaacctacggttaccttcaccgtcctacaacccagtcaagtcgtacgtctacggacgtaccgtaagtaagttagtttcgtacgttaaagttttacgttacgtacgtaccgacgtacgaacggtacggtacgtaccggtacgtcccgtacccggttacccgttaaacgtttaaacggttttcgggacccgggtaacgggggtacccgggtaacgggggttacggtaaaccgtttaccgtaaaacgttccggtaaacgttcgggtcgtaccgtaacgaccgtacctagtccttcgtttacttaccgtttcccg

SEQ ID NO: 321849 - DNA, 785 bp, Homo sapiens
  misc_feature: GZ8MTXP02JV0N8.25.76.G10.1.454.CMB.2.raw
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtgggggtccctgagactctcctgtgtagcctccggattcagcttcagacaaatatagtgtagaactcgggtccgccaggcctccggaggggaaggggcgtggggaggtggggtcgctagtttcggtagagtaggtagtagtaacttaataaaactactacgacagtagtacgaggtggggacgggtccgtagttccaacgttatcctacccgaaagaacgaaaccaaaccgaacccgaaagacgtaccttaagttttttcgtttacccgtaggtaacctaaaaagttacggaaaacccgtacgggtacccgttaggggaaaccgggtaacgggacccccgggaaaaggggttaaccggttaaccccgggggtaactttccggtttaggttttaaaagttttaagtttcgggttaggaacccgggtaaaaggtaaacccgtaaaaggttaaaaccggtaaaacggaaaccggttaaggggttcggggtaacccgtttagggggtaccttttacgggaacccgtttaaccggggttccggggggaacccctaaaccccgggggg

SEQ ID NO: 321850 - DNA, 571 bp, Homo sapiens
  misc_feature: GZ8MTXP02JXJAR.25.76.G10.1.454.CMB.2.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (283)..(283): a, c, t, g, unknown or other
  misc_feature (283)..(283): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaacccaccggcgaaattgtgttgacacagtctccagccaccctgtctttgtctccaggggaaangccacgctctcctgcagggccagtcagngtatcggcaggtccttagcctggtatcgacagacgccctggccaggctccaggctccnatctatgatgctactccaacgacggggcccacgtcggacccgtccccagacctaggttccaggtcggcccgtaggtggggtcctaggggacaggtacttcgacctctcaccatcagcagtctagacgtcgtagaagtatttgacttagtttattacgtacgtccagcgagcgtagcgtacgtcgccgttccgtaactacgtttcggaccgtaggggaccgtacggggtcgtacgtacgaaagtacgaacgtggtcggcgtcgacctacgtctcgtcgtccttactacc

SEQ ID NO: 321851 - DNA, 623 bp, Homo sapiens
  misc_feature: GZ8MTXP02IQ3JH.25.76.G10.1.454.CMB.2.raw
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtgggggtccctgagactctcctgtgtagcctccggattcagcttcagacaaatatagtgtgaacgtgggtccgccgaggcctaccgaggggaaggggctgggaggtgggtcgctagttcggtgagtagtagtagtaacttaataaactactacgcagagtcaggtgggagggccgattcactatcctaccaagacgaacaaacaccaaagagcttattttgttctgacaaaattcggaaacctgcccgtagaacggacggaccgaaggtacgtaaccgggcttcgtagttaatttagttggtaggaccgaaaggaacttaaagaaaaggaacgaacgtaggtgggaaccgtgggggtactttacggaacttaccggggtcgggggaccctaaaccggggg

SEQ ID NO: 321852 - DNA, 615 bp, Homo sapiens
  misc_feature: GZ8MTXP02I0TQI.25.76.G10.1.454.CMB.2.raw
  modified_base (302)..(302): a, c, t, g, unknown or other
  misc_feature (302)..(302): n is a, c, g, or t
  modified_base (371)..(371): a, c, t, g, unknown or other
  misc_feature (371)..(371): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (408)..(409): a, c, t, g, unknown or other
  misc_feature (408)..(409): n is a, c, g, or t
  modified_base (427)..(427): a, c, t, g, unknown or other
  misc_feature (427)..(427): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaactggcggaggtcgggggagcgtggtccaggccggggaatccctgagctctcctgtgcagtcgtccgcgtccaccttcgtcgtttgctattccacgtcgggtcccnccaggcctccgaggcaaggggctgggagtggggtggcgtcagtagtgggtggatggaatatgctatttngcagctccgtgaacgggccactcaccntcncgagngnngctacgaatactctttanctgactaagttacgaaaccgtgaacgtactacggaacgtaacgcggttacctaggtttacctaagtttaccggttgggacccgggttacgggggttactacggggaaaaacggttaccggacgggggttcccggggaccccgtttacggaaaccggggcctaggttccgggaaccggttccccggggg

SEQ ID NO: 321853 - DNA, 709 bp, Homo sapiens
  misc_feature: GZ8MTXP02HPVUH.25.76.G10.1.454.CMB.2.raw
  modified_base (358)..(358): a, c, t, g, unknown or other
  misc_feature (358)..(358): n is a, c, g, or t
  modified_base (401)..(401): a, c, t, g, unknown or other
  misc_feature (401)..(401): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgtcttgggttttcctcgttgcttcttttaagaggtgtccagtgtcagatgcaacgtggcggaggtcgggggagcggtggtccgaggccggggaagtcccgtaggacgtactcgtccgtggtgcaggtcgtcccgccgtcccaccgttccgtcgtttgctattcacgtggtcccgcaggcctccgaggcgaagggctgggagtgggtggcggtnagtagtgggtaggagtagggaaactagtgtacttagttttagngacgtaagtaccgtcccggtaaggaaccggggccctaaccgtaccaacccgtaacgtcccgtacccgaaggacggaccaacggtaccctaacccgaaaacgtaaccctttaaccgtttttaactccgttaagtaacccgttaaagttaaccggaaaaacccggttgaaacgtaaccgtacggaacgtaccgaacggtctacgtaccttaagttaccgcggccggtacggggttacaacggaacgtaaaccgtggggtcccggggtacctacggtaaccggcgttacggtaccgggacccgtcccgggg

SEQ ID NO: 321854 - DNA, 715 bp, Homo sapiens
  misc_feature: GZ8MTXP02GRGVF.25.76.G10.1.454.CMB.2.raw
  modified_base (349)..(349): a, c, t, g, unknown or other
  misc_feature (349)..(349): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtgggggtccctgagactctcctgtgtagcctccggattcagcttcagacaaatatagtgtagaacgtgggtccgccgaggcctccggaaggggaaggggcgtgggaggtggggtcgcagtttcggngagttagtagtagtaacttaataaactacgtacgacaagtagtcgaggtggggacgggccgtattccaacttatcctaccaagaacgaaacaaacaaccaaagacgtacttagtttttgttactagaactaaaagttagaaaccacggtacccgttaggaaggaacgggacccgggaaaaggtacggttaaccgggtacctttacgttagtttaaacgttttaagttcggggtttacggaccggaaaaggtaaacctaaaagttaaaaagggaaacgtaaaaccgtaggggtttacggggccgttagggggtaccttttaggaacccgttaaacggggttccgggggacccgtaaaacccgggggg

SEQ ID NO: 321855 - DNA, 622 bp, Homo sapiens
  misc_feature: GZ8MTXP02JA29T.25.76.G10.1.454.CMB.2.raw
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtgggggtccctgagactctcctgtgtagcctcggattcagcttcagcaaatntagtgtgaactggtcccncaggctaccgaggggaagggcgtggaggtgggtcgcgtagttcggtgagtagtagtagtacttaataaatactacgacagagtcgaggtgggagggccgattcacttatcctccaagacgaacaaccgaaaccaagacgtcttaatttttcgttcagaacaaagttcgaaacacgtcctgaaggacggtacccgaaaggtctaacgggcttcttagttatttagttggtagaccgtaaagtacaaaggttaaaagacgtaacgtaggtagggccgttagggggtaccttacggaaccgtttaccgggagggggtacccctaaacggggg

SEQ ID NO: 321856 - DNA, 699 bp, Homo sapiens
  misc_feature: GZ8MTXP02HZVL0.25.76.G10.1.454.CMB.2.raw
  modified_base (260)..(260): a, c, t, g, unknown or other
  misc_feature (260)..(260): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtgggggtccctgagactctcctgtgtacgcctccggnttcagtcttcagacaaatatagtgtgaacgtgggtcccgcaggcctccgaggggaaggggctggggaggtggggtcgctagtttcggtggaggtagtagttagtaacttaataaactacgtacgacagagtcgaggtggggacgggccgtattccgacttactcctacccgaagacgaaaccaaaccaaccgtaaaggacgtacttagtttttttcgttacctaggactaaaatacgaaacgtacgtaccgtaggaacggaacggcccggaaaggggacttaccggggtctttacgttagtttaaagtttagtttcggtaggaccggtaaaggaacctaaaaggtaaaaacggaacgtaacgtaaggggtcgggtccgtagggggtacttttacgggaaccgtttaaccgggtcggggggaacccctaaaacccggggg

SEQ ID NO: 321857 - DNA, 659 bp, Homo sapiens
  misc_feature: GZ8MTXP02IM2X0.25.76.G10.1.454.CMB.2.raw
  modified_base (410)..(410): a, c, t, g, unknown or other
  misc_feature (410)..(410): n is a, c, g, or t
  modified_base (494)..(494): a, c, t, g, unknown or other
  misc_feature (494)..(494): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtggcgggaggtcggggggagcggtggtccgaggccggggaagtcccgtggacgtactctcctgtgcgtagtcgtccgcgtccctaccttccgttcgttttggcctattcgacgtcgggtcccgccaggcctcccgaggcgaaagggcgtgggacggttggggtcggcggtcagtagtgggtggggatagggaaagttatgacttagttttangactaagtccgttcggtagaacggggccctactaccctacactcctacgaggaccgcagccttacgaaagtaccttaacctttnaccttgaaccttaaagtacgaaaaccgtgtacgaccgtacgaaccgacgaaccgtctacgtaacttacgtacgtcggcggtacggggtctacggtaaaacggaacgttcggggaaccgggtactaacccgggtacggaccgttaaggccggaacccggtccgggg

SEQ ID NO: 321858 - DNA, 570 bp, Homo sapiens
  misc_feature: GZ8MTXP02FF56L.25.76.G10.1.454.CMB.2.raw
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
  modified_base (457)..(457): a, c, t, g, unknown or other
  misc_feature (457)..(457): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactgggtggagtcgtgggggagcctggtcaaggccgtggggggtccctgagactctctgtgtagcctcggattcagcttcagacaaatatagtgtagaacgtcgggtaccgccgaggcctccggaaggggaggggctggggaggttgggtcgcgtagttcggtagaggttagtagtagttacttaataactacacgcagagtcaggtggaggccgtatcatanctacaganacaacacagagtctatttttcgtctagacaatagaacngcagagagccgagactacggcttgtgtatttagtggcgacgaagactaaagtaaacgaacgacgaggtggcgttggggtacttcggactacgggtacggggacctaaacgggg

SEQ ID NO: 321859 - DNA, 661 bp, Homo sapiens
  misc_feature: GZ8MTXP02HSU6Y.25.76.G10.1.454.CMB.2.raw
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggtttccttgttgctattttagaaggtgtcctgtgtgaggtgcaactggtggagtcgtgggggagcctggtcaagccgtgggggtccctgagactctcctgtgtagcctccggattcagtcttcagcaaatatagtgtagaacgtgggtccgccgaggccgtccgaggggaaggggctggaggtgggtcgcgtagttcgtgagtagtagtagtaactataaactactacgcagagtacaggtggacgggctagttcactagtctaccgaaganaacaacaaccaagntacttattttgtttcacgtactaaatagaaactagccgttagaacggacggaccgaagggtaaccttacgggacctttacgggttattaagttttaaacgtggtaccggtacggaaggaaacctaaagttaaaaggaaacggaccgttaaagggtcgggtaacccggttgggggtaccctttaagggaacccgtttaccggggtacgggggaaccccttaaaacccggggg

SEQ ID NO: 321860 - DNA, 565 bp, Homo sapiens
  misc_feature: GZ8MTXP02GTQ3A.25.76.G10.1.454.CMB.2.raw
  modified_base (281)..(281): a, c, t, g, unknown or other
  misc_feature (281)..(281): n is a, c, g, or t
  modified_base (313)..(313): a, c, t, g, unknown or other
  misc_feature (313)..(313): n is a, c, g, or t
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
  modified_base (506)..(506): a, c, t, g, unknown or other
  misc_feature (506)..(506): n is a, c, g, or t
tcagactgtacagtcacgaccggtgctcgatttagtcactcatacagggggagagaggagccttagccctggattccaaggcctatccacttggtgatcagcactgagcaccgaggattcaccatggaactggggctccgctgggttttccttgttgctattttagaaggtgtcctgtgtgaggtgcaactggcggagtctggggggaggcctggtcaagcctggggggtccctgagactctcctgtgtagcctccggattcagcttcagcaaatatagtntgaactggtccgccaggctcagggaaggggcnggagtgggcncagttcgngagtagtagtagtaacttataaaactactacgcaagagtacagtggggagggccgtattcaactaatcgtacccagacgtaacaaacaaccaagtagcaatttttgttcagactaaatgaaacagcctgagagccgaaggatacggctgtntaactattggngcgaaagactaanaaagaacgaacgaagtagggcgtacggtacgtacgtacgtacgtacgggtacggaacgg

SEQ ID NO: 321861 - DNA, 690 bp, Homo sapiens
  misc_feature: GZ8MTXP02F4KGK.25.76.G10.1.454.CMB.2.raw
tcagactgtacagtcacgaccggtgctcgatttagtcactcatacagggggagagaggagccttagccctggattccaaggcctatccacttggtgatcagcactgagcaccgaggattcaccatggaactgggctccgctgggttttccttgttgctattttagaaggtgtcctgtgtgaggtgcaatggcggagtcgtgggggaggccgtggtcaagccgtgggggtccctgagactctcctgtgtacgcctcggattcgagtcttcagacaaatatagtgtgaacgtgggtcccgcgaggcctaccggaggggaacggggcgtggaggtgggtcgcgtagttcggtgaggtagtagtagtaattaataaactacacgacagtagtacgacggtggggacggccgtattccacttactcctaccgaagaacgaaccaaaccgaaacccgaaagacgttaccttagttttttaccgttctaagactaaaaagttacgaaaacccgtacggacccgttaaaaggaccggtacccggggaaaggtaccgtaacgggtactttcgttaggttaactttagttcggtaggacctaaggaaactaaaggtaaaacggaacgtaacgtacgggcggttacgtaaggggtcctttaaggaccgtagggtaccggggaccgtaacggggtaaccccg

SEQ ID NO: 321862 - DNA, 770 bp, Homo sapiens
  misc_feature: GZ8MTXP02ILWV2.25.76.G10.1.454.CMB.2.raw
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcggaggtcggggggagcgtggtccgaggccggggaatcccgtgagacctctcctgtgcagtcgtccgcgtccaccgttccgtcgttttggcctattccgacgttcggggtccccgccgaggcctcccgaggcgaaggggctgggagtggggtggcggtcagtagtggggtagggatagggaaagtaactggacttaagtttttagcggtacaaggtacccttccgggttaggaaaaccgggggcccctaaacgttacccaaacccgtattcccgaaccgagggaacgggaccacgggacccttacccgaaaaacgtaaaccctttaccttttttaaacgccgtagtaacccttaaacgtttaccggaaaacccggtttggaaaccggttaccgtaccggtaacccggaaccggtaccgggtacttcggttaaccctttacgttaacgttcgggaccggggtaccgggggtaccgttaagggaaaacggaccggtaaacgggggttccccgggggtacgttacccggtaacgggcccgttaagggtacggggaacccggtcccggggg

SEQ ID NO: 321863 - DNA, 957 bp, Homo sapiens
  misc_feature: GZ8MTXP02FNR33.25.76.G10.1.454.CMB.2.raw
  modified_base (185)..(185): a, c, t, g, unknown or other
  misc_feature (185)..(185): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (451)..(451): a, c, t, g, unknown or other
  misc_feature (451)..(451): n is a, c, g, or t
tcagactgtacagtcacgaccggtgctcgatttagtcactcatacaggggagctctgggagaggagcccagcactagaagtcggcggtgtttccatccggtgatcagcactgaacacagaggactcagcatggagtttgggctgcgctgggttttcctcgttgctcttttaagaggtgtccagtntcagatgcaactgggcggaggtcggggggaggcggtcggtaccaggccggggaagtccctgagactcnccgtgngcgagtcggtccgcgtccctaccttccggtcgttttggcctaatttccgacgttcggggtacccgtccgagggtcctcccgtaggccgtaaacggggtacgtggggtaaggtcgggggtacggccgggttactaaggtagttgggggtagggtagtaggggaaaagttaaatcggtattaagttttttacgngtaccgtaaaggaccggtttacccgggtagggtaaaacgggggccccgtaaccgttacctaaaccccgacgtttacccgtacccgaaaaggggaacccggtaccggtaaaccggaccgttaaaaccccgtaaaaccggtaaaaacccccgtttaaacccccttttttttaaaccgggttaccttaaaccggttaaacccgtttaaaaacggtttaacccgtaaaaaaaacccgggggttttcccgaaaacgggggtaacccctttaaaccggaaaacccggaaccccggggtaaacggtcccgtttaacgggtttaacccttaaacgttttaaccccgtgggggtaacccgggggtacccgggggtttaaaagttaaacgggggaaaaccgttaaaccggggtaaaccggggggtttaacccgggggtaccccggttttaaaacccgggaccggggtaccccggtaaacggtttcggggaaccccggggtttaaaccccggggggg

SEQ ID NO: 321864 - DNA, 661 bp, Homo sapiens
  misc_feature: GZ8MTXP02GBEMB.25.76.G10.1.454.CMB.2.raw
  modified_base (198)..(198): a, c, t, g, unknown or other
  misc_feature (198)..(198): n is a, c, g, or t
  modified_base (304)..(304): a, c, t, g, unknown or other
  misc_feature (304)..(304): n is a, c, g, or t
  modified_base (522)..(522): a, c, t, g, unknown or other
  misc_feature (522)..(522): n is a, c, g, or t
tcagactgtacagtcacgaccggtgctcgatttagtcactcatacagggggaggaactgctcagttaggacccagagggaaccatggaggccccagctcagcttctcttcctcctgctactctggctcccagaaaccaccggacgaaattgtgttgacacagtctccagccaccctgtctttgtctccgaggggaaanacgccacgctctcctgcaggccagtcagagtagcggacaggtaccttagccgttggtatcgacagacgccctggccaggcctcccgaggcctctacagtcctagtnagtcacgtaacctaccgaaacgtaccgggaccctacgttaccggacccgtacccgaaggtaccgttagggttaccagggtcgaggtacgggtcggtacgtagggaccaaggttccttaccgaacctcctccgaaacccttgacggtacactagtacgtaacgacgtactaagtaaagtttacctttgaacctttaagtttactactcgtacaaggtanacggttacgtacgcggtactccgggtaccttcgtaaaagtttcggttacggaccggtaaacggggtcgaggggttacgtacttaacgacgtacgtaagtcgcgtactcggactacgtagttccctgttaccgtctaccg

SEQ ID NO: 321865 - DNA, 526 bp, Homo sapiens
  misc_feature: GZ8MTXP01C3NCH.8.14.B03.1.454.CMB.2.raw
  modified_base (315)..(315): a, c, t, g, unknown or other
  misc_feature (315)..(315): n is a, c, g, or t
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (455)..(455): a, c, t, g, unknown or other
  misc_feature (455)..(455): n is a, c, g, or t
  modified_base (467)..(467): a, c, t, g, unknown or other
  misc_feature (467)..(467): n is a, c, g, or t
  modified_base (478)..(478): a, c, t, g, unknown or other
  misc_feature (478)..(478): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacccgcaccttgcccagtgcatcaatttccataccttagtgtatattggtatcagcagaagccagggagtccctcccactatctcctgaggtaataaaacagactcaagataaggagcaggcctntggacgtccccagccccgcttctctggactaaccaaagntgctggcggccaagtgcgagggtattgctnatcngtgggctcgagtttgaggtatggagggtctagtacttagttattgtatgtaatttggtactagggancggtgttggggngtagttcgggnggaggaccgagcgtgacccgtcgtaggtccacggtcccaagggtcccg

SEQ ID NO: 321866 - DNA, 523 bp, Homo sapiens
  misc_feature: GZ8MTXP01AKO9D.8.14.B03.1.454.CMB.2.raw
  modified_base (289)..(289): a, c, t, g, unknown or other
  misc_feature (289)..(289): n is a, c, g, or t
  modified_base (351)..(351): a, c, t, g, unknown or other
  misc_feature (351)..(351): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggatcctcccatatctcctgaggtataaaacngactcagataaggagcaggcctcgtggacgtccccagccccgcttctctggactaccaaagntgctgcggccaatgcaggggtatttgctgatctcgtgggctcgtagtttgaggatgaggggctgacttattatgtatgtatttggacaggagcgtgttgggttgagttcggggagggtaagggcccaaggccttggacccggtccgttagggccagtccccgaagggtcccg

SEQ ID NO: 321867 - DNA, 551 bp, Homo sapiens
  misc_feature: GZ8MTXP01DSR0N.8.14.B03.1.454.CMB.2.raw
  modified_base (290)..(290): a, c, t, g, unknown or other
  misc_feature (290)..(290): n is a, c, g, or t
  modified_base (352)..(352): a, c, t, g, unknown or other
  misc_feature (352)..(352): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccataccttagtgtatattggtatcagcagaagccagggagtcctccccatatctcttgaggtaataaaacngactcagataaggagcaggcctcgtggacgtccccagccccgcttctctggatacccaaagntgctgcggaccaatgcagggagtttgctcatctcgtgggctccgagtttgaggtatgaggggctgtacttattattgtatgtaatttggtactaggagtcggtcgtttgggggttgtagttcggggacgggtacggggaacccgttaaggcgtcgggtaacccgtccgttacgggccacggtccccgaaggggtccccg

SEQ ID NO: 321868 - DNA, 515 bp, Homo sapiens
  misc_feature: GZ8MTXP01EGWKB.8.14.B03.1.454.CMB.2.raw
  modified_base (292)..(292): a, c, t, g, unknown or other
  misc_feature (292)..(292): n is a, c, g, or t
  modified_base (357)..(357): a, c, t, g, unknown or other
  misc_feature (357)..(357): n is a, c, g, or t
  modified_base (460)..(460): a, c, t, g, unknown or other
  misc_feature (460)..(460): n is a, c, g, or t
  modified_base (470)..(470): a, c, t, g, unknown or other
  misc_feature (470)..(470): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccatacctttagtgtatattggtatcagcagaagccagggacgtccctccccatatctcctgagtaataaaacngactcagataaggagcaggcctgtggacgtccccagcccccgcttctcgtggactaacccaaagntgctgcggaccaagtgacgtagggtatttgctcatctcgtggctcgtagttgagatggagggctgacttattatgtatgtatttgtagaggtgcgtgttgggngagttcgggnggtaggaccgagcgtgaccgtcgaggtcacggcccgaaggtcccg

SEQ ID NO: 321869 - DNA, 725 bp, Homo sapiens
  misc_feature: GZ8MTXP01EIKPE.8.14.B03.1.454.CMB.2.raw
tcagctcgcgtgtccacgaccggtgctcgatttagtgtgagtagtacgtgcggggtaagaggttgtgtccaccatggcctggactcctctcctcctcctgttcctctctcactgcacaggttccctctcgcagactgtgctgactcagccggcttccctctctgcattctcctggagtcatcagccaatgtcacctgcaccttgcccagtgcatctaattttccattacctttagtagtatacttggtattcagcaagaacgccaggggactccctacccactatcctaccgtaggaacggtaactaaaacagtacctcgaagtaagtaaggacgacgacggtccgttacgtcgggaaaccgttcccccgaacgtcccgtactttcgtacgtacggtaaaccttacccgaaaggtcttacggaccgttacgggacccgggacctaaacgttcggaccggtaagggggttacgttttcgggactttcggaacgtttccgtcgttacggggtccttacccgtaggttttacggaagggttagttacggggggaacgtccgttaacggtacctttaagttaccgtttagttagttagttacgttttacggacgttacgggtcgtaacggttcgtttagggggcttaggttccggggacgggttacgggacccgaaggtccgttacgggaacccgttcggttaacgggttcctaacggccccgtaaggg

SEQ ID NO: 321870 - DNA, 607 bp, Homo sapiens
  misc_feature: GZ8MTXP01EGDYI.8.14.B03.1.454.CMB.2.raw
  modified_base (287)..(287): a, c, t, g, unknown or other
  misc_feature (287)..(287): n is a, c, g, or t
  modified_base (358)..(358): a, c, t, g, unknown or other
  misc_feature (358)..(358): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcactgcaccttgccagtgcatcaatttcattacctttagtgtatattgtatcagcagaagccagggactccctcccatatctctagagtaataaaacngactacaagagtaaggacgcgacggccttcgtggaccgtccccagccgtcttctcgtaggaactaccaagntcgactggaccgacaagtcggacgtaggggttatttcgcttcgattcgtcgttcgggccttcgtaggtttgaagggtagtggggaacggtcttagtaactttattagttcgttataggttaagtttgggaaacgtgggtacgtcggttgtttgggggcttaagggccggggtaagggaacgggttcaaaccgggttcgacggttaacccgttcgggtacggacccgaacggttaaccccgtaacccggg

SEQ ID NO: 321871 - DNA, 603 bp, Homo sapiens
  misc_feature: GZ8MTXP01DNGIY.8.14.B03.1.454.CMB.2.raw
  modified_base (302)..(302): a, c, t, g, unknown or other
  misc_feature (302)..(302): n is a, c, g, or t
  modified_base (356)..(356): a, c, t, g, unknown or other
  misc_feature (356)..(356): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgccagtgcatcaatttcatactttagtgtatattgtatcagcagaagccagggactcctcccatatctcctgagtaataaaacagactacagaataaggancaggcctcgtggacgtcccccagcccgtcttctcgtggaaacttacccaaaggntcgacgtcggacggacaagtcggacgtagggttacgtttcgcttactagttccgtcgtcgggtaccttacgtagttaggagtagtggggaggtctagtaacttattagttgtagttgttagttcggagagggtggtcggtggttggggtacgacggtccgggggaacgggaacgggttaaccgaacggtccgtaccggtaacccggttacggtacgggttaccgaaccgggttaaccccggtaacgg

SEQ ID NO: 321872 - DNA, 518 bp, Homo sapiens
  misc_feature: GZ8MTXP01A5T31.8.14.B03.1.454.CMB.2.raw
  modified_base (478)..(478): a, c, t, g, unknown or other
  misc_feature (478)..(478): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggatcctcccactatctcctgaggtataaacagactacagataaggagcgaggcctctggacgtccccacgccgtcttctctggaactaccaagatgctcggccggtcaagtgacgagggtagtttgctcattcgtcgtgggtcctcgagtttgaggtatggggaggtctagacttattagttgtattgtatttggatggagcgtgttgggtgagtcgggnggacggacagcgtcggccgtcgaggttcaacgcccgaagg

SEQ ID NO: 321873 - DNA, 598 bp, Homo sapiens
  misc_feature: GZ8MTXP01DNIZ3.8.14.B03.1.454.CMB.2.raw
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctccgtggagcatcagccaatgtcacctgcaccttgccagtgcatctaatttccattacctttagtgtatagttgtatcagcaagaagcgagggactcctcccatatctcctagaagtaaataaaacagtactacaagaagtaaagggagcgaacggccctcgtacgggaaccgtccccgaacggtccccccgtctttcgtaccgtaggaactaaacccgaaaagtcgtcgcgtacgggccggaaccaaagtcggacggaaggggttcgtttgaccttcaattcgtcgtcggggtcctaccgtaggttaggaagacgttggacgggtctagtaacttatttagtgtatcggtagtttggaacgaggtgcgtggttgggcgtaggcgggacggaagaccgagcgtaagccgtgtagcacgcccgaagtcccg

SEQ ID NO: 321874 - DNA, 502 bp, Homo sapiens
  misc_feature: GZ8MTXP01E2FEA.8.14.B03.1.454.CMB.2.raw
  modified_base (351)..(351): a, c, t, g, unknown or other
  misc_feature (351)..(351): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (474)..(474): a, c, t, g, unknown or other
  misc_feature (474)..(474): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggacgtcctccccactatctcctgaggtataaaacagactcagataaggagcaggcctctggacgtcccccagccgcttctctggaatccaagntgctgcggcaatgcagggtagtttgctcatctcgtgggctccgagtttggagatgggaggtctgactattattgtatgtattggtacaggngcgngttgggngagtcgggcggagggccagcncgaaccgtctaggcaacgcccgaacggg

SEQ ID NO: 321875 - DNA, 621 bp, Homo sapiens
  misc_feature: GZ8MTXP01CSTOJ.8.14.B03.1.454.CMB.2.raw
  modified_base (230)..(230): a, c, t, g, unknown or other
  misc_feature (230)..(230): n is a, c, g, or t
  modified_base (293)..(293): a, c, t, g, unknown or other
  misc_feature (293)..(293): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgccagtgcatcaatttcattactttagtntatattggtatcagcagaagccgagggactccctcccatactctcctagaagtaaataaaacngaactacgaagaataaaggagacgacggcctgtacgggacctccccgagtcccccgtctttactcgtaggactaaaccgaaaagtcgtcgactcgggaccggtacaagtcgacgtagggttatttcggctctacttcgtcgtcgggtcctacgtaggtttgaggtataggagggtcttaggtaactttagttaagttgtattggttaagtttggaacgaggtgtcggtaaggtttgggagtacggttcggggaacggacggaaccgttggttaccgtcgggtaacccgttcgttagggacccgttacggaaccccggttaagtccccg

SEQ ID NO: 321876 - DNA, 554 bp, Homo sapiens
  misc_feature: GZ8MTXP01BPCTJ.8.14.B03.1.454.CMB.2.raw
  modified_base (369)..(369): a, c, t, g, unknown or other
  misc_feature (369)..(369): n is a, c, g, or t
  modified_base (486)..(486): a, c, t, g, unknown or other
  misc_feature (486)..(486): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccatacctttagtgtatattggtatcagcagaagccagggactccctccccactatcctcctagaaggtaataaaacagactcaagaataaggagacgaggtcctcgtggacgtccccagccccgtcttctcgtggactaacccgaaaagntgcctaggccggaccaagtgcgaggggtatttgctcatcgtcgtgggtcctcgtagttgaggtatggaggtcttagaactttagttattgtattgtacgtttggaagtaggagtcgngttgggngnggttcgggaggtacggacgagcgtaacggaccgtcgtaggtcacgcccgaaggtccccg

SEQ ID NO: 321877 - DNA, 708 bp, Homo sapiens
  misc_feature: GZ8MTXP01C3KNI.8.14.B03.1.454.CMB.2.raw
  modified_base (652)..(652): a, c, t, g, unknown or other
  misc_feature (652)..(652): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccatacctttagtgtatattggtatcagcagaagccgagggactccctcccactatcctcctagaagtaaataaaacagactacaagataagggagacgaggcctcgaggaccgtcccccaggcccccgtcctttactcgtacgggaacttaaacccgaaaagtcgttcggcccgttacggggacccgggaccctaaaagttcgggaccggtaagggggtttacgttttcggaccttactaacgtttcccgtacgggtttcgggggtccctttacccggttaaggttttgggaagggtaattggggtaacggggtcttaggttaaactttagttttaagtttgttaagtttcggtttaagttttagggtaacgaggggagttcgggttaacgtttgggggttagtacggttcggggacgggacgggttaaccgnggttccgtaacggtaccccgttcgttaacggcgacggtaaccccgaagggtccccg

SEQ ID NO: 321878 - DNA, 605 bp, Homo sapiens
  misc_feature: GZ8MTXP01B7TUO.8.14.B03.1.454.CMB.2.raw
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgccagtggcatctaatttccattacctttagtgtatattggtatcagcagaagccagggacgtcctcccatatctcctagaggtaataaaacagactacaagaataaggagcgaaggcctcgtcggacgtccccacgccgcttctctaggaacttaccaagatgctcggcggaccaaagtggactaggggtatttgcttcatccgtcgtcgggtacctacgaggtttagaggtagttggggaaggtctagtaattagttattgtattagtacgtttgggtaactagggtaggcgttcggtttgggggtagttacggtacgggggtacgggttaacggggaccgaaacgggtcgtaacgggtcccgttacccgtaggggttacctaaccggaacccgtaaccggg

SEQ ID NO: 321879 - DNA, 723 bp, Homo sapiens
  misc_feature: GZ8MTXP01BSTNP.8.14.B03.1.454.CMB.2.raw
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctccgtggagcatcagccaatgtcactgcaccttgccagtgcatactaattccattacctttagtgtatattgtatcagcagaacgcgaggtctccctacccatactctacgtagaagtaaataaaacagactacgaagaagtaaggagcgacggtccgttcgtacggaccgtccccgacggcccgtcgttacctacgtacggtaaaccttaaccgaaaggtacgtcgggtccgtacgggaccggtaccgtaaagttcggacggtagggggttacttttcggaccttacgtacgtttccggttaccggttcggggtccttaccggttagggtttacgggaaagggttggtacgggggtaagggttacctttaacggtaaattttaagtttaacgttaggttaacgtttaggttagttttaacggggaagtagggtaacggtcgggttcggtttagggggtacgttacgggtaccgggggacgggttaaacgggccgaagggtccgtacgggtaacccgttacggacggttaccgaaccggttaacccgtaaccggg

SEQ ID NO: 321880 - DNA, 609 bp, Homo sapiens
  misc_feature: GZ8MTXP01D7LNZ.8.14.B03.1.454.CMB.2.raw
  modified_base (378)..(378): a, c, t, g, unknown or other
  misc_feature (378)..(378): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatctaattcattactttagtgtatattgtatcagcagaagcgaggactccctcccatatctccgtagaagtaaataaaacagactacgaagaagtaaggagacgacggccttacgtacggaccgtccccgacgcccccgtcttcgtcgtaggactaaacccgaaaagngtcgccgtacggccgacctaagtcggacgtaggggttatttcgctactacttcgtcgtggtctcgtagttgagtatggaggtctagtacttagttagtgtattgtagtttggaacgaggtcgtcgtaaggtttggggagtacggttcggggacgggaacgggaaccgttggttccgtaacgggtaacccgttcgtaagggtcccgaaccggtaaccccgttaaggtccccg

SEQ ID NO: 321881 - DNA, 546 bp, Homo sapiens
  misc_feature: GZ8MTXP01CF31Z.8.14.B03.1.454.CMB.2.raw
  modified_base (473)..(473): a, c, t, g, unknown or other
  misc_feature (473)..(473): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgccagtgcatcaattccataccttagtgtatattgatcagcagaagcagggagtcctcccactatctcctagaggtataaaacagatacccaagactaaaggagacaggcctcgtaggacgtccccacgccgcttctctggaactaccaagatacgctgcggaccaaagtcgacgagggtagtttgcttactatctcgtgggccttccgtagtttgaggattggggaggtctagtacttattagttgtagttagtagtttggtacgtagggngtcggtgttggggtgaggtcgggcggagggaccaaggtcgtgaaccgttcgaggttcaacggccgtaaccggg

SEQ ID NO: 321882 - DNA, 751 bp, Homo sapiens
  misc_feature: GZ8MTXP01AX9JW.8.14.B03.1.454.CMB.2.raw
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgccaccttgcccagtgcatactaatttccattacctttagtgttattattggtatcagcagaagcgagggactccctacccactactctccgtagaagtaaataaaacagactacgaagaagtaaagggacgacgacggcctacgtacggaccgtccccgacgccccgtcttcgtacgtaggactaacgaaagtcgtcgcgtacggaccggaacctaagtcgggtacggtaagggggttactttcggccttactacgttccgtttccggtcggggttacccttaccggttaagggtttcgggaaagggttagtttacggggaagggggttactttagggttaaactttaagttttagttaggttacgtttaggtttaacggttttacgggaaacgtagggggtacgtacggggtttgggttttagggggacggtacggggttaccgggggaaacgggggaaccgggttaaacccgttaagggttcccggttaaccgggtaccccggtttaacgggtaacgggtacccgacccgggtaaccccggaagggtccccccg

SEQ ID NO: 321883 - DNA, 748 bp, Homo sapiens
  misc_feature: GZ8MTXP01A59TA.8.14.B03.1.454.CMB.2.raw
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccattacctttagtgtatattggtatcagcagaagccgagggactccctccccactactctcctagaaggtaaataaaacagactacaagaagtaaagggacgacgaaggcctacgtagggaccgtacccccgacggcccccgtactttctcgtaggacttaacccgaaaaggtgtacgcgtacgggaccgggtacccgtaaagtcgggaccgtaagggggttacgttttcggaccttacgtacgtttccgttaccggttcggggtcccttacccggtaaggttttcgggaagggtaagttggggaacgggggtcttaacggttaactttaagttttagtttacgttaagtttagggttaaagttttcggggtaaacgtaggggtaggtccgggttaaggtttgggggttaggtaacgggttccgggggtaacggggtaacggggaacccgttaagggttcccgtaacgggtaccccggttccggttaacgggggtacccaccgggtaaccccggttaacgggttccccg

SEQ ID NO: 321884 - DNA, 593 bp, Homo sapiens
  misc_feature: GZ8MTXP01DXIPK.8.14.B03.1.454.CMB.2.raw
  modified_base (366)..(366): a, c, t, g, unknown or other
  misc_feature (366)..(366): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcacttgccagtgcatcaattccatacctttagtgtatattggtatcagcaagaagcagggactccctaccccatatcctcctgaaggtaataaaacagacctacaagataaggagacaggtcctcgtggacgtcccccgagcccgtctttcgtcctaggaactaccaaagntcgctcgcggaccaaagtgacgagggtagtttgcttacattccgtcgttggggtccttaccgtaggttttggaaagggtgtagggggtacggtacttaggtaacgtttattaagttgttaagttagttacgtttaggtacgagggtagcgtgttgggtagttagtcgggcgggaacgggccaaggcgttacgaaccggttctacgggttctaacggcccgtaacggg

SEQ ID NO: 321885 - DNA, 727 bp, Homo sapiens
  misc_feature: GZ8MTXP01CCA5N.8.14.B03.1.454.CMB.2.raw
  modified_base (246)..(246): a, c, t, g, unknown or other
  misc_feature (246)..(246): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgccaccttgcccagtgcatctaatttccattactttagtgtatattggtatnagcagagccagggactccctcccatatctcctagaagtaaataaaacagactacaagaagtaaggagacgaggtcctcgtacggaccgtccccgaggtcccccgtcttctcgtacggaactaacccgaaaagtcgtacgtaccgtacgggacccgggtaccgtaaacggtcgggaccggtaagggggtttacgtttcggaccttacgtacgttcccggtacgggttcggggtccttaccggttaaggtttagggaacgggtacgttagggacggggttacgtttaagggtaaacgtttattttagttagttaagtttgggttaaacgtttttgggaaacgtaggtcggtcggtgggtttgggttacggtaaacgggttccgggggtaaacgggaacggggttaaacccgttgggttaccgtaaccgggtacccggttaacgttaacggggacaaccggtaaccccggaagggttcccccgg

SEQ ID NO: 321886 - DNA, 740 bp, Homo sapiens
  misc_feature: GZ8MTXP01DCL7W.8.14.B03.1.454.CMB.2.raw
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcactgcacttgccagtgcatcaatttccatacctttagtgtatattggtatcagcagaagccaggacgtcctcccatatctctgaagtaataaaacagactacaagaataaggagcgacggccttacgtacggacgtcccccgaacggtcccggtactttcgtaccgtgggtaaaacttacccgaaaggtactacggtccgttacgggacccgggaccgtaaagtcggacgtaaggggtacgttttcgctacgttaatccgttacgttggggtacccttacggtaaggtttgggaaacgggtagttggggggtaacggtaccgtttaggtaaaaccttttagttttaagttttggtaagttttaggttaaacggtttttggggaaacgggtacggggttacggttaaccgggttgggttttagggggtacggttacggggttaccgggggaaccggggttaaacggggttacccgttaacgggttcccggtaaccggttaacccggtttacccggtaacgggttacccgtaaaccggttccccggtaacgg

SEQ ID NO: 321887 - DNA, 711 bp, Homo sapiens
  misc_feature: GZ8MTXP01AV7JD.8.14.B03.1.454.CMB.2.raw
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtccacctgcaccttgcccagtgcatcaatttccattacctttagtgtatattggtatcagcagaagccgagggactccctcccatatcctcctgaaggtaataaaacgagactacaagataaaggagacgaacggcccttcgtagggaccgtcccccgacggtcccgtctttcgtcgtacgggtaaacttacccaaaggggctcgccgtcggaccggaccaaagtcgggtacgtaggggttactttcgccttctattccgtcggtcgggtcctacgttagtttggaggtagtggggacggtacttaggtaactttaagttttagttaggtttaagtagggtttaacgtttttacggggaaacgtaacgggggtggtcccgggtttcgggtttgggggtaacggttacgggttcccggggggaacgggggaacccgggggttaccaaacggggtcccgttaacgggtaacccccggtttcggtaaacggggttcccgtaaccggaacccccgggtaaaccgggg

SEQ ID NO: 321888 - DNA, 597 bp, Homo sapiens
  misc_feature: GZ8MTXP01DE42A.8.14.B03.1.454.CMB.2.raw
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (530)..(530): a, c, t, g, unknown or other
  misc_feature (530)..(530): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttcattacttagtntatattgtatnagcagaacgcgaggactcccnccatntctctagagtaaataaaacngactacaagaagtaaggagacgaggcctgtacggaccgtccccacgtcccccgtcttcgtcgtacggaactaaaccgaaagtctcgtcgtacgggaccggaccaagtcggacggtagggttatttcggctacgtattcgtcggtcgggtcctacggtagttggaaggtagtcgggaggtcgttagtaatttagttagttgtagttagttaagtttaggacgagggtcgtcggtggtttagggngtacggttcgggacggacggacgagttccgtaacggaccgtccgtagccgacgcccgaaggtccccg

SEQ ID NO: 321889 - DNA, 609 bp, Homo sapiens
  misc_feature: GZ8MTXP01ESTZA.8.14.B03.1.454.CMB.2.raw
  modified_base (372)..(372): a, c, t, g, unknown or other
  misc_feature (372)..(372): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatctaattcattacttagtgtatattgtatcagcagagcgaggactccctcccatactctacctagagtaaataaacagactacgaagaagtaaggacgacgacggcctacgtacggaccgtccccaggcccccgtcttctcgtaggactaaaccgaaagtntcgtcgtcgccggaccaagtcgacggtaagggttgttcgctacgtacgttcgtacggtcgggtccttacggttaggttagaaggtagtcgggacggttacgttacgtaattagtttagttagttacgtgttaacgtttggaacgagggtcgtcggtgttggggagacggttcggggacggaacgacgttagccggtaaggacccgtcgtaggaccaccggtaaccgaacggtccccg

SEQ ID NO: 321890 - DNA, 754 bp, Homo sapiens
  misc_feature: GZ8MTXP01DYUTA.8.14.B03.1.454.CMB.2.raw
  modified_base (176)..(176): a, c, t, g, unknown or other
  misc_feature (176)..(176): n is a, c, g, or t
  modified_base (273)..(273): a, c, t, g, unknown or other
  misc_feature (273)..(273): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (391)..(391): a, c, t, g, unknown or other
  misc_feature (391)..(391): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggancatcagccaatgtcacctgcacttgccagtgcatctaatttccattactttagtgtatattggtatcagcaagaagccgagggactccctcccatanctcctagaagtaaataaaacngactacaagaataagganccgtaaggccttcgtacgggacccgtaccccgacggtccccccgtctttcgtcgtaaggaccttaaacccgaaaaagtnttcgacgtacgggacccggaacctaaagttcggaccggtaggggttagttttcggcttacgtagttcccgttcggttcggggttcccttaccgggttaaggtttacgggaaggtaaagtttcgggaagggggttaccttagggttaaacttttaagtttaaagtttggttaagtttaggttaaaccgtttttgggaaccgtaggggtagtccgggttggttttagggggacgtacgggttaccggggtaacggggtaaccggggttaacccgaaacggttccggttaaccgggtaaccccggttaaccgggttaacgggtacccgaaccgggttaacccccggaaacgggtttcccccccggg

SEQ ID NO: 321891 - DNA, 700 bp, Homo sapiens
  misc_feature: GZ8MTXP01EFEGZ.8.14.B03.1.454.CMB.2.raw
  modified_base (175)..(175): a, c, t, g, unknown or other
  misc_feature (175)..(175): n is a, c, g, or t
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctctggancatcagccaatgtcacctgcacttgccagtgcatcaatttccattacctttagtgtatattggatcagcaagaagccgagggactcctcccatactctctagaaggtaataaaacagacctanaagaacgtaagggntacgaggtccttagacggacgtcccccaggtcccctcttcgtactacggaaaactacccgaaaggtcttagaccgtcggaccggtaccaaagttcggacgtagggttattttggccttacctagttacccgttcgttcggggtcccttacgtaagttttagggaaagggttattacggggggaaacgggtttacgttaacggttaaacgtttaagtttaacgtttagttaagtttaggtttagtttaccgggtaacggtaagggtcggtaacggttcgggttagggtacggttacgggtaccgggggtaacggaacgggttaaccgttacggtccggtacggtaacccggttacgtacggttacccgtaaccggttaacccgtaacgg

SEQ ID NO: 321892 - DNA, 705 bp, Homo sapiens
  misc_feature: GZ8MTXP01BF1KW.8.14.B03.1.454.CMB.2.raw
  modified_base (230)..(230): a, c, t, g, unknown or other
  misc_feature (230)..(230): n is a, c, g, or t
  modified_base (279)..(279): a, c, t, g, unknown or other
  misc_feature (279)..(279): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcacttgccagtgcatcaatttccattactttagtntatattgtatcagcagagccgaggactcctcccatatctctgaagtaanaaacagactacaagaagtaaggagcgacggccttcgtaggaccgtcccccacggtcccgtcttcgtccgtaggaaacttacccaaaggtctcgcgtacgcgggaccctaaagtcggcgtaaggggttacgtttcgcgttactaacgttccgttccggtcggggtcccttaccggttaagggtttggaaagggtagttaggggggtaacggttccgttaaggttaactttaaagttttaggtttagtttaacgttagggtttaacggtttttagggaaccgtagggggtaacggtccgggtttacgggttggggggttcgttaaggggttacccggggggtacggggaacggggttacccgaaacgggtccgtacgggtaaccccggttacggttacgggaccgtaaccggaacccggtaacccggg

SEQ ID NO: 321893 - DNA, 512 bp, Homo sapiens
  misc_feature: GZ8MTXP01ESURC.8.14.B03.1.454.CMB.2.raw
  modified_base (386)..(386): a, c, t, g, unknown or other
  misc_feature (386)..(386): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccatacctttagtgtatattggtatcagcagaagccagggacgtcctccccactatcctcctgaggtaataaaacagactcaagataaggagcaggcctctggacgtcccccagcccgtcttctctggaactaccaagatgctgcggccaatgcgagggtatttgctnattcgtcgtgggcttcgagtttgagatgggaggtctagacttattagtgtatgtgttgganaggngcgtgttggggnagtcggggnggacgggcagcgtagccgtcgtaggttcaacgccgtaagg

SEQ ID NO: 321894 - DNA, 586 bp, Homo sapiens
  misc_feature: GZ8MTXP01A4Q85.8.14.B03.1.454.CMB.2.raw
  modified_base (270)..(270): a, c, t, g, unknown or other
  misc_feature (270)..(270): n is a, c, g, or t
  modified_base (305)..(305): a, c, t, g, unknown or other
  misc_feature (305)..(305): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (518)..(518): a, c, t, g, unknown or other
  misc_feature (518)..(518): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgccagtgctatctaatttccattactttagtgtatattgtatcagcagaagcgaggactccctccactntctctagaagtaataaacagactacagataaggancgaggcctacgtggacgtccccacgccgtcttcncgtacggaactaccaagntcgcgtcgcgacaagtcgacgtagggtatttcgcttactattcgtcgtagggtccttacgtaggtttggagttcgtagggggaacgtcgtttagtaactttagtttaagttgttaagtagttacgtttagggacagggtcgtaacggtgtttaggggaacncgggtacggggacggttaagggacccttaggcgtacgaaccgttcgaagttccgaacgttcccgaacg

SEQ ID NO: 321895 - DNA, 617 bp, Homo sapiens
  misc_feature: GZ8MTXP01D5D6Q.8.14.B03.1.454.CMB.2.raw
  modified_base (370)..(370): a, c, t, g, unknown or other
  misc_feature (370)..(370): n is a, c, g, or t
  modified_base (406)..(406): a, c, t, g, unknown or other
  misc_feature (406)..(406): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaattccattaccttagtgtatattggtatcagcagaagccagggacgtccctccccactactcctcctagaaggtaaataaaacagactcagaataaggagcaggcctcgtggacgtccccgagtcccccgcttctcgtaggaactaacccaaaagngtgctgaccggaccaagtggacgagggtgtttgctntatctcgtgggctcgtagttgaggagttgaggggtctggtacttatttagttagtagttagtagtttggtaacgagggtacgtccggtgtttgggggttagtaacggttccggggacgggggtaaccgggaaccgaaacggttccgttaacgggtaaaccccggttcggttaaaccggggtcaacccgggtcccggaaaccggttccccgg

SEQ ID NO: 321896 - DNA, 653 bp, Homo sapiens
  misc_feature: GZ8MTXP01BY01E.8.14.B03.1.454.CMB.2.raw
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccatacctttagtgtatattggtatcagcagaagccagggactccctcccatatctcctagagtaataaacngactcagaataaggancaggcctcgtggactccccagcccccgtcttctcgtaggacttaacccgaaaagcgttcgccgttacgggacccggaccctaaagtcgggaccgtaagggggttacgttttcgaccgttctaacgttccgttccggtcggggtcccttaccggtaggtttcggaagggtagtgggaacggggtcttaggtaacttagttttaagttgtaaagttggttaagttttcggtaacgaggtacgtcggtaaggtttggggttgacggttcggggacgggtaacgggacccgaggttccgtaacggtacccggttaacgtacgggtccgaacgtccccgttaagggtccccg

SEQ ID NO: 321897 - DNA, 601 bp, Homo sapiens
  misc_feature: GZ8MTXP01AZCYS.8.14.B03.1.454.CMB.2.raw
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcacttgccagtgcatctaatttccattacctttagtgtatattggtatcagcagaagccgagggacgtccctacccatatcctacctagaaggtaataaaacagactacaagaagtaaaggagcgaaggcccttcgtggaccgtccccacgcccgtcttctcgtaggaacttaccgaaagctagctagcgggaccaaagtcgacgagggttacgtttgctcattcgtcgtgggctcgtagttggagtgtgggagtctagtacttagttagttgtagttagttagtttggtacgtagggtagtcggttggtttgggggagttaggtccggggacgggaacgggacccaaagggtcgtaccggtaacccggttcgttacgggaccgtaaccggaacccggtaaccggg

SEQ ID NO: 321898 - DNA, 697 bp, Homo sapiens
  misc_feature: GZ8MTXP01AJPRS.8.14.B03.1.454.CMB.2.raw
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttcgccagtgcatctaattccatactttagtgtatattgtatcagcagaagccgagggacgtccctcccactatcctcctgaaggtaataaaacagactacgaagaagtaaggagacgacggccgtcgtcggacgtccccgacgcccgtcttctacgtggaaactaccgaagacgtggctcggccggtaccgaaatcggaccggtaaggggttagtttcgccttcgtaacgttccgttcggtggggtacctccggttaagggtttggaacgggtagttagggggacgggtacgttacgtaaacgttttagtttaagtttgttaacgtttaggttaagttttcgggggtaaaccgagggggtacgtcggggttcgttttggggggacttacggggaccggggtcggggaaacggggacccttaaagggttccggtacgggtaacccccggttcgggttaaaccgggccccgtaacggggttaacccccgtaacccgggg

SEQ ID NO: 321899 - DNA, 899 bp, Homo sapiens
  misc_feature: GZ8MTXP01BTIU1.8.14.B03.1.454.CMB.2.raw
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcactgcacttgccagtgcatctaattcattacttagtgtatattgtatcagcagaagccgagggacgtcctcccatatcctcctagaaggtaataaaacagactacgaagtagtaaaggacgacgaacggtcctcgtacgggaccgtcccccgacggtccccgtactttcgtaccgttacgggtaaaacttaacccgaaaggtacgttacgggaccgttacgggaccccgggtaaccctaaagttacgggacgggtaagggggtttaacgtttttccgggaccctttaccgtaagtttccccggttaccgggtttacggggggtcccctttttaccgggtaaagggtttttacggggaaaacgggggtttaacgttaggggggggtaacgggggtttaccccgtttaaagggttaaaccttttttaaaaggtttttaagttttacgggtttaaaaggtttttaacgggtttaagggttttttaaaccggggggaaccgtttaaggggggaaccgttaaccgggggttttcccgggtttttaggggggggtaacggttacgggggtttaccggggggtaaccgggggaaaacccggggggttacccttaaaacgggggttcccggttaaccccgggggtaaaccccggttttaccggggttaaacccggggttccggtaaaccccggggcccccggttaaaacccgggggg

SEQ ID NO: 321900 - DNA, 712 bp, Homo sapiens
  misc_feature: GZ8MTXP01D9E9W.8.14.B03.1.454.CMB.2.raw
  modified_base (262)..(262): a, c, t, g, unknown or other
  misc_feature (262)..(262): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagcccggcttccctctctgcatctcctggagcatcagccaatgtcactgcaccttgcccagtgcatcaatttccattacctttagtgtatattgatcagcagaagcagggactccncccactatctctagaaggtaaataaaacagactacgaagaataaaggagacgaacggtcctacgtcggaccgtcccccgagcccgtcttacgtcgtaggtaaactaccgaagtagtcggccgtaggacccggaccgtaaaggtcgggacgtaggggttacggtttggccttaccgtacgttcgttccggttacggggtcccttaaccggttaagggttttcggaaaggggtacgtttagggggaaacgggttcccgttaagggttaactttaagttttaaagtttgttaagtttacggtttaaagttttcgggtaaacggtaggggtaacggttaaccggtttcggggttgggggttacgttaacggttcgggggaacgggaacggggacccttaaagggtccgtacggtaaccgttcggtacggttacgtaaccggaaccccgtaacgg

SEQ ID NO: 321901 - DNA, 866 bp, Homo sapiens
  misc_feature: GZ8MTXP01CWWH2.8.14.B03.1.454.CMB.2.raw
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgccaccttgcccagtgcatactaactttcattacctttagtgtattattgtatcgagcgaagacgccgaagggtactcccctacccacttactcctccgtaaggtaagtaaataaaaccgagtaacctacgaagtaagtaaggacgaccgaacggtcccgtcggtacggtaaccgtcccccgaacggtccccccgttaccgtttccgtcgtacgggtaaccttaaaacccgaaaaggtcgtacgtccgtacgggtaccggtactaaacggtcgggaccgggtttaagggttacgtttacgcctttacgtaccgtttccggtacgggtttccgggggtacccttaccgggttaggggtttacggaaacgggttagttaacggggaccggtttaacgttaccgggtttaaattttaaacggttttagttaaacgggttacgtttaaggggtttaaggttttaacgggaacccgggttaaggggtaccggttcggggttaacggggtttaggggggttaccggtaacggggttcccgggggaaccgggggtaaacggggttaaacccccggttaagggttcccgggtttaacccccgggggttaacccgttaaccgggggttacggggaccccgttaaaccccgggaaccccgggttaacgggggttcccccccg

SEQ ID NO: 321902 - DNA, 705 bp, Homo sapiens
  misc_feature: GZ8MTXP01AU26G.8.14.B03.1.454.CMB.2.raw
  modified_base (308)..(308): a, c, t, g, unknown or other
  misc_feature (308)..(308): n is a, c, g, or t
  modified_base (586)..(586): a, c, t, g, unknown or other
  misc_feature (586)..(586): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgccaccttgcccaggtgcatcaactttccattacctttagtgtatagttgtatcagcaagagcgaggggtactccctaccccactatcctaccgtagaaggttaaataaaacgnggaacttacaaggaaataaaggacgacgaacggccttcgttacgggaaccgtccccgagtccccccggtctttcgtcgttacgggaactaacccgaaaagggtaacttcggaccgttgggacccggggacctaaaggttcgggaccgtaaaggggggttttcgtttacggctacgtcgttcgtcggtcggttccttacggtaggttaggaggttacgtacggacgggttcgtagttatttaaggtttagttagtagttaggttaacggttagggtagngggtacgtcgggtggttaggggttggtacgggacggggacggggaacggttaccgttcgggttccgtaaccgggtaccgtaacggtacggtccgaccggtaacccgttaacggtccccg

SEQ ID NO: 321903 - DNA, 750 bp, Homo sapiens
  misc_feature: GZ8MTXP01D9W8V.8.14.B03.1.454.CMB.2.raw
  modified_base (320)..(320): a, c, t, g, unknown or other
  misc_feature (320)..(320): n is a, c, g, or t
  modified_base (391)..(391): a, c, t, g, unknown or other
  misc_feature (391)..(391): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctccgtggagcatcagccaatgtccacctgctaccttgccagtgacatactaatttcattacttagtgtatattggtatcagcaagaacgccgagggactccctacccactactctcctagagtaaataaacagactacaagaagtaaggacncgaacggcctacgtacggaccgtcccccaggtcccgtctttaccgcgttaggaaaccttaacccgaaagtnttaccgggctacgggacccgggaacctaaagggtcgtaaccggggtaagggggttttacgttacgccgttacgtacgtttcccggttcggttaccgggtcccttacggttaaggggttacggaaggttacggttaggggtaacggttcgtttaagtttaaacgttttaagtttagtttacggtttaagtttacggtttaagggtttacgggaacgtaggggtcggttcgggtttggggttacggggtacggttacggggtacgggggacggggttaaaccggggttacccttacggttcccggttaacggaaccccggtttcggtacgggttacccgtaacccgggttaacccggtcgg

SEQ ID NO: 321904 - DNA, 631 bp, Homo sapiens
  misc_feature: GZ8MTXP01CP5F3.8.14.B03.1.454.CMB.2.raw
  modified_base (391)..(391): a, c, t, g, unknown or other
  misc_feature (391)..(391): n is a, c, g, or t
  modified_base (497)..(497): a, c, t, g, unknown or other
  misc_feature (497)..(497): n is a, c, g, or t
  modified_base (547)..(547): a, c, t, g, unknown or other
  misc_feature (547)..(547): n is a, c, g, or t
  modified_base (561)..(561): a, c, t, g, unknown or other
  misc_feature (561)..(561): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgctaccttgcccagtgcatacaatttcattactttagtgtattgttgtatcagcagaacgcgagggtactccctaccccatactccgtacctagtaaggtaaataaaacagactacgaagaagtaagggagacgacggtcctacggtacggaccgtccccagtccccctacttctacgtaggactaaaccgaaagtntcggaccgtcggacgaccgtagtcgacggtagggttagtttacgcgttcacgttcgtcgttcggggtccttacggttaggtttgaaggttacgagggttaacggtnttacggttatttaagtttgttagttagtgttagttacggtaagagggtcncgggttggttgggngtacgggcgggtagggacggacgacgttcgtaaccggtcgtaacggtcgtacgcgaaccggaacgtcccg

SEQ ID NO: 321905 - DNA, 583 bp, Homo sapiens
  misc_feature: GZ8MTXP01BZTMF.8.14.B03.1.454.CMB.2.raw
  modified_base (265)..(265): a, c, t, g, unknown or other
  misc_feature (265)..(265): n is a, c, g, or t
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
  modified_base (502)..(502): a, c, t, g, unknown or other
  misc_feature (502)..(502): n is a, c, g, or t
  modified_base (520)..(520): a, c, t, g, unknown or other
  misc_feature (520)..(520): n is a, c, g, or t
  modified_base (529)..(529): a, c, t, g, unknown or other
  misc_feature (529)..(529): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccattacctttagtgtatattgatcagcagaagccagggacgtcccncccatatctcctgagtaataaaacngactcaagataaggancaggcctgtcggacgtcccccgacgcccgtctttcgtcgtaggtaaactacccaaaggctcggaccttcggccggaccaaagttcggccggtaagggggtattttcgactctagttcctcggtggggtcctcgttaggtttgaggtagtcgggaaggtcgtagtaacttatttaagtgttagtgtagtttccgganggtagtcgtgttgggagnggtcggggnggaacgggttcaaggtcgtcgaaccgttcgaagttccgaacgaaccccgtaagg

SEQ ID NO: 321906 - DNA, 512 bp, Homo sapiens
  misc_feature: GZ8MTXP02GIRSC.8.14.B03.1.454.CMB.2.raw
  modified_base (352)..(352): a, c, t, g, unknown or other
  misc_feature (352)..(352): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccataccttagtgtatattggtatcagcagaagccagggagtccctccccactatctcctgaggtaataaaacagactcagataaggagcaggcctctggacgtccccagccccgcttctctggataccaaagntgctgccggccaaatgacagggagtttgctcatctctgggctcgtagttgagagtgaggctgatattattgtatgtatttggacaggagcgtgttgggtgagtcgggacggacgggaacaaggcgtggacccgtcgtacggtcacggcccgaaggtcccg

SEQ ID NO: 321907 - DNA, 568 bp, Homo sapiens
  misc_feature: GZ8MTXP02FHHE9.8.14.B03.1.454.CMB.2.raw
  modified_base (330)..(330): a, c, t, g, unknown or other
  misc_feature (330)..(330): n is a, c, g, or t
  modified_base (369)..(369): a, c, t, g, unknown or other
  misc_feature (369)..(369): n is a, c, g, or t
  modified_base (499)..(499): a, c, t, g, unknown or other
  misc_feature (499)..(499): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcactgcaccttcgcccagtgcatctaatttccattacctttagtgtatattgtatcagcagaagccgagggacgtccctccccactatcctcctggaaggtaataaaacagactacaagataaaggagcgagggtcctcgnggaccgtccccacgcccgtcttctcgtggactaccaagntgctgccggacaaatgacgaggggtagtttgctcattctcgtggggacctccgtagtttggaaggatgggacggtctagtaacttatttagttgtattgtacgtttggacgagggcgcgtgttggggtanaggtcgggacgggacgggaaccaaaggcgtacggacccgttacgtacggtacacggaccccgaaacggg

SEQ ID NO: 321908 - DNA, 502 bp, Homo sapiens
  misc_feature: GZ8MTXP02JSM38.8.14.B03.1.454.CMB.2.raw
  modified_base (350)..(350): a, c, t, g, unknown or other
  misc_feature (350)..(350): n is a, c, g, or t
  modified_base (439)..(439): a, c, t, g, unknown or other
  misc_feature (439)..(439): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggagtcctccccactatctcctgaggtataaaacagactcagataaggagcaggcctctggagtccccagccccgcttctctggatccaaagntgctgcggccaaatgcagggagtttgctcatctctgggctccagtttgaggatgaggctgactattattgtatgatttggtacaggagngcgtggtgagtggcggacgggaccgaagcgtcgacgtccgtacggtcgacgaccgaacgccgg

SEQ ID NO: 321909 - DNA, 505 bp, Homo sapiens
  misc_feature: GZ8MTXP02FRFLT.8.14.B03.1.454.CMB.2.raw
  modified_base (290)..(290): a, c, t, g, unknown or other
  misc_feature (290)..(290): n is a, c, g, or t
  modified_base (348)..(348): a, c, t, g, unknown or other
  misc_feature (348)..(348): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccataccttagtgtatattggtatcagcagaagccagggagtcctccccactatctcctgagtataaaacngactcagataaggagcaggcctctggagtccccagccccgcttctctggatccaaagntgctgcgccaatgcagggatttgctcatctctgggctccagtttgaggatgaggctgactattattgtatgagtttggacaggagcgtgttggggtgacgtcggggacggacgggaccaagcgtggaccgtccgtaggtccagacccgaaggtcccg

SEQ ID NO: 321910 - DNA, 700 bp, Homo sapiens
  misc_feature: GZ8MTXP02GRQI2.8.14.B03.1.454.CMB.2.raw
  modified_base (398)..(398): a, c, t, g, unknown or other
  misc_feature (398)..(398): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccattacctttagtgttatattggtatcagcagaagccgagggactccctcccactactcctcctagaaggtaataaaacagaactacgaagaagtaaaaggacgacgaacgggtcctacgtagggaccgtacccccacggcccgtacctttccgtcgtaggtaactaacccgaaagtntacggcgttaggccgggaacccaaagtcggaccggtaaagggggttacgttttcgacttactaagttcccgtcggtcgggggtacccttaccggttaaagggtttggaaaggggttaatgggtaacggggttcttaggtaacctttaagtttaagttaggttaattcgggttaaagttttcgggaagtagggggtactccgggtaggtttagggggtagaacggttccgggggacgggaacggggaacccaagggtccgtacgggacccgtttacggagtacccgacggtacccgtaacggg

SEQ ID NO: 321911 - DNA, 505 bp, Homo sapiens
  misc_feature: GZ8MTXP02IE149.8.14.B03.1.454.CMB.2.raw
  modified_base (354)..(354): a, c, t, g, unknown or other
  misc_feature (354)..(354): n is a, c, g, or t
  modified_base (453)..(453): a, c, t, g, unknown or other
  misc_feature (453)..(453): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggagtccctccccactatctcctgaggtataaaacagactcagataaggagcaggcctctggacgtccccagcccccgcttctctggactccaaagntgctgccgcaatgcagggtattgctcatctcgtgggctccgtagttagaggatgaggctagacttagttattgtatgtattgactggagcgtgttgggnagtcggcggagggaccaagcgtgaccgtcgtacggcacggacccaagtcccg

SEQ ID NO: 321912 - DNA, 564 bp, Homo sapiens
  misc_feature: GZ8MTXP02JCZPX.8.14.B03.1.454.CMB.2.raw
  modified_base (355)..(355): a, c, t, g, unknown or other
  misc_feature (355)..(355): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccataccttagtgtatattggtatcagcagaagccagggactcctccccactatctcctgaggtaataaaacagactcaagataaggagcaggcctcgtggacgtccccagcccccgcttctctggactaccaaagntgctggccggaccaagtgcgaggggtatttgctcatcgtcgtgggctcgtagtttgaggtagtggaggctgtacttatttaattgtattgtagtttagggtacgtagggagtcggtcggtttgggggtagtaacgggttcggggacgggtacgggaacccgaaggtcgtaacggtaccgtcgtacggtccgacggacccgaaggtcccg

SEQ ID NO: 321913 - DNA, 506 bp, Homo sapiens
  misc_feature: GZ8MTXP02ISLYX.8.14.B03.1.454.CMB.2.raw
  modified_base (360)..(360): a, c, t, g, unknown or other
  misc_feature (360)..(360): n is a, c, g, or t
  modified_base (459)..(459): a, c, t, g, unknown or other
  misc_feature (459)..(459): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccattacctttagtgtatattggtatcagcagaagccagggactccctccccactatctcctagaggtaataaaacagactacaagataaggagcaggcctcgtggactccccagcccccgcttctctggactaccaaagntgctgccgaccaatgcgagggatttgctcatctgtcggctccgagttgagatgagcttgattattattgtatgtatttggaacaggagcgtgttgggtnagtcgggcggacggacaagctgacgtctaggcacgacccaggtcccg

SEQ ID NO: 321914 - DNA, 544 bp, Homo sapiens
  misc_feature: GZ8MTXP02FX6QH.8.14.B03.1.454.CMB.2.raw
  modified_base (292)..(292): a, c, t, g, unknown or other
  misc_feature (292)..(292): n is a, c, g, or t
  modified_base (393)..(393): a, c, t, g, unknown or other
  misc_feature (393)..(393): n is a, c, g, or t
  modified_base (447)..(447): a, c, t, g, unknown or other
  misc_feature (447)..(447): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcatccaatgtcacctgcaccttgcccagtggcatcaatttccatacctttagtgtatattggtatcagcagaagccagggagtccctccccactatctcctgagtataaaacngactcagataaggagcaggcctcgtggacgtccccagccgtcttctctggactaccaagatgactgccggacaaagtgacgaggggtactttgctcattcncgtgggctcgtagttgaaggatggagctgattattatgtatgttattcggtaanggagtcggtgtttggggcgaagttcggggacgggaacgggaccgtaaaggtccgtacggtacccgttacgtaacggtcgaaccggcccgtaacgggg

SEQ ID NO: 321915 - DNA, 554 bp, Homo sapiens
  misc_feature: GZ8MTXP02H42DK.8.14.B03.1.454.CMB.2.raw
  modified_base (176)..(176): a, c, t, g, unknown or other
  misc_feature (176)..(176): n is a, c, g, or t
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggancatcagccaatgtcacctgccaccttgccagtgcatcaatttccattactttagtgtatattgtatcagcagaagcagggatccctcccatatctcctagaggtaataaaacagacctanagagtaaaggagcaaggcctctggaactccccaagcccgcttcnctggactccaaagntgcngcgacaagtgagtaggtattcgctactactcgtcgtcggtctacgtagttagaggtagtaggacgtatagtaacttaagttagttagtaagtagttagtttaggtacgagggtcgtcggtcggttggtacggtacggtacgggacgggacggaacgaacgtaacgtacgaccgtacgtacgtacgaccgaccgacg

SEQ ID NO: 321916 - DNA, 675 bp, Homo sapiens
  misc_feature: GZ8MTXP02FUMNJ.8.14.B03.1.454.CMB.2.raw
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccattaccttagtgtatattggtatcagcagaagcgagggacgtccctcccactatctcctgaggtaataaaacagactacagaataaggagacaggcctcgtggacgtccccgagccccgtcttctcgtaggactaccaaagctagctggccgaccaaagtcgacgtaggggtattttcgctacacttcgtcgtcggggtaccttaccgttagggtttaggaagggtagttacggggaaacggtccgttaggtaactttaaagtttagtttagttaaggttacggtttagttttaacggggtaagaggggtacggtccggttacgggtttagggggtaggtaacgggtccgggggtaacggggacggggtaaacctaaacggtccggttaacgggtaacccccggtttacgtacgggggtaccaaaccgggtaccccggtaaacggggtcccccg

SEQ ID NO: 321917 - DNA, 558 bp, Homo sapiens
  misc_feature: GZ8MTXP02I6SN4.8.14.B03.1.454.CMB.2.raw
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (337)..(337): a, c, t, g, unknown or other
  misc_feature (337)..(337): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccattacctttagtgtatattggtatcagcagagccgagggatccctcccatatcctcctgagtataaaacngactcagataaggncaggtcctcgtggacgtccccagcccgtcttcncgtggaactaccgaagctgacgtcgccggaccaaagtcggacgaggggtatttcgcttcattcgtcgtggggtctacgtagttcgaggtatcggaggtctagtacttattagttagtacttggtatttaggacgaggtcgtcggtcggttagggtgaacgttcggggacggacggacctaagtcgtacggtaacccgttcgtaggtccacgaccgtaacgg

SEQ ID NO: 321918 - DNA, 621 bp, Homo sapiens
  misc_feature: GZ8MTXP02FNBNN.8.14.B03.1.454.CMB.2.raw
  modified_base (359)..(359): a, c, t, g, unknown or other
  misc_feature (359)..(359): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccattacctttagtgtatattggtatcagcagaagccaggacgtccctccccactatctcctgagtaataaaacagactcagataaggagcaggcctcgtggacgtccccagccccgtcttctctggactaccaaaagtntgctgccggaccaaagtggacgtaaggggtagttttgccgttacagttcccgttcgtcggggtccttaccggtaggtttaggagggtattgggaaggtctaggtaattagtttagttaggttataggttagttttagggaagtaggggtaagtcggtacggtttgggggagtaacgggttcgggggacggtaacgggggaacccaaggtccgtaacgggtacccgtacgtaacgggtccacgggtacccgaacggggtcccg

SEQ ID NO: 321919 - DNA, 578 bp, Homo sapiens
  misc_feature: GZ8MTXP02GFMJQ.8.14.B03.1.454.CMB.2.raw
  modified_base (380)..(380): a, c, t, g, unknown or other
  misc_feature (380)..(380): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccattacctttagtgtatattggtatcagcagaagccgagggacgtccctccccaactactctcctagaggtaaataaaacagactacaagaataaagggacgacgacggccttcgtaggacgtcccccgagcccccgtcttctcgtaggactaccgaaagntgctggccgaccaagtgacgaaggggtatttgctcattcgtcgtcgggtctccgtagtttgaggtatggacggtctgtacttatttagttagttatgtatttggacgaggagtcgtagtttggggagtacgtcggggacggacggtaaccgagccgttaagacccgttacgtacggtccacggacccgaacggtcccg

SEQ ID NO: 321920 - DNA, 751 bp, Homo sapiens
  misc_feature: GZ8MTXP02HGLSX.8.14.B03.1.454.CMB.2.raw
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtccacctgcaccttgcccagtgcatcaatttcataccttagtgtatattgtatcagcagaagccagggactccctccccatatctcctagaggtaataaaacgagactacaagaagtaaagggacgcgaacggccttacgtacgggaccgtcccccgagccccccgtctttcctacgtagggacttaccgaaaagcgtcgctggaccggacctaaagtcgggaccggtaagggggttacgttttcggaccttacgtaactttcccgttccggttcgggggtaccctttaccgggttaagggttttacgggaagggttacgttacgggtaaacggggtcctttaagggttaaacttttagttttaaaggtttaggtttagttaagggtttaagtttttacggggtaaacggtagggtacggtccggtttcgggttagggggtttagaaccggggtttcggggaaccgggggtaacggtaacccggtaaacggtccgttaaccgggtaccccggtttacggtaaccgggtacggaacccggaccccggtaaaacggttcccccgg

SEQ ID NO: 321921 - DNA, 555 bp, Homo sapiens
  misc_feature: GZ8MTXP02JORVJ.8.14.B03.1.454.CMB.2.raw
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (417)..(417): a, c, t, g, unknown or other
  misc_feature (417)..(417): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccattacctttagtgtatattggtatcagcagaagccagggactccctcccactatctcctagaaggtaataaaacgagactacagaataaggagcaggcctcgtggacgtccccagccgnttctctggaactaccaagntgactcggcgaccaatcgacgtagggtagttgctcatctcgtggctcgagttgaggtntggagtctagtacttattagttgtattgtaacgttggtagtaggtagtcggtgttgggggtatacgggtcggggacgggaacggaccgaaggtccgtacggtacccggtacgtacgggtaccaccggaccgtaaccgg

SEQ ID NO: 321922 - DNA, 656 bp, Homo sapiens
  misc_feature: GZ8MTXP02HF4GV.8.14.B03.1.454.CMB.2.raw
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (461)..(461): a, c, t, g, unknown or other
  misc_feature (461)..(461): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgccagtgcatcaatttccattacctttagtgtatattggtatcagcagaacgccgagggactccctcccatatctcctgagtaataaaacngactnagataaggancaggcctcgtggacgtcccacgccgtcttctcgtaggaactaccgaagtcttcggcttcggaccggtaccaaagttcgggaccgtagggggttacgttttcgcttacgtattccgttcgtcggggtccttacccgtaggtttcgggaaagggtnttacgggacggtacgttaggttaacgtttaatttaggtttacggttaagttaggttacgttttagggtaacgtaggggtacggttcggtcggtttgggggtacgtaacggtccggggacggggtaacggaccgtaaaggtccggttaccggacccggttaccggttagggtacccgacggaccccggtaaccggg

SEQ ID NO: 321923 - DNA, 547 bp, Homo sapiens
  misc_feature: GZ8MTXP02ITIO4.8.14.B03.1.454.CMB.2.raw
  modified_base (363)..(363): a, c, t, g, unknown or other
  misc_feature (363)..(363): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccattacctttagtgtatattggtatcagcagaagccagggagtcctccccactactctcctagaggtaataaaacagactcaagataaaggagcgaggcctcgtggaccgtccccagccccgtccttctctggataccaaagntgctggccgccaagtcggcgaggggtagtttgctcgatctcgtcgggctccgtagttgagtagtggagtcgttgtacttagtttatgtatgtagtttggagtaggagcgtaggttgggtgtacggtcggggcggacgggacgaagcgtaacgaccgtacgtacggtcacggaccgaacggtccg

SEQ ID NO: 321924 - DNA, 575 bp, Homo sapiens
  misc_feature: GZ8MTXP02JZ0DL.8.14.B03.1.454.CMB.2.raw
  modified_base (377)..(377): a, c, t, g, unknown or other
  misc_feature (377)..(377): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccattacctttagtgtatattggtatcagcaagaagccaggggactccctccccactatctcctgaaggtaataaaacagactcaagaagtaaaggagacgaagggcctcgtacggacgtcccccgaggcccccgtcttctctggactaccgaaaagntgctggcggacctaaagtgcgtaggggtagtttgctcatcgtcgtcggggccttaccgtaggtttgaggtagtaggaggtctagacttagttagttgtaagtgtagtttaggacgtagggagcgttcggttgggtcgaggtcgggcgggacggaccgtaagccgtgacccgtcgtacggcaacggcccgaaggtcccg

SEQ ID NO: 321925 - DNA, 619 bp, Homo sapiens
  misc_feature: GZ8MTXP02JME3Y.8.14.B03.1.454.CMB.2.raw
  modified_base (291)..(291): a, c, t, g, unknown or other
  misc_feature (291)..(291): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccattaccttagtgtatattggtatcagcagagccagggactccctccccatatctcctagagtaataaacngactcagataaggagcaggcctcgtggacgtccccgagcccccgtcttactcgtaggactaccgaaagtctgacgtggaccggtacaagtcgacgtaggggtagtttcgactcgtactccgtcgtcgggtccttacgtaggtttagaggtagttggacggtcttaggtactttagttagttgtagttaggttaccgttttagggaacgtaggggtagtccggtaggtttgggggttacgacggttacccgggggacgggtacgggaacccgtaaggtcttaacgggacccggttacgtacggtcaaaccggccccgtaaggtcccccg

SEQ ID NO: 321926 - DNA, 695 bp, Homo sapiens
  misc_feature: GZ8MTXP02IFBSV.8.14.B03.1.454.CMB.2.raw
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (375)..(375): a, c, t, g, unknown or other
  misc_feature (375)..(375): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttcccctctcgcagactgtgctgactcagccggcttcccctctctgcatctcctggagcatcagccaatgtcacctgcaccttgcccagtgcatcaatttccattacctttagtgtatattggtatcagcagagccgagggactccctcccactatcctcctgaagtaataaaacngactacagaagtaaggancgaggtccctcgtggaccgtccccacgtcccgtctttccgtcgtacggtactaccaaggtntcggccgtgaccgggtacctaaagtcggacggtaggggttacgtttcgacttatacgttccgtcggtacgggtccttacgtaggtttggaaaggtagtagggacggtaccttaggttaactttaagtttagtttacgggttaagttagggttaaacgtttttaggggaacgtaaagggggtacgggtttccggttaaggggtttcgggggaaaggtttacgggaccgggggtaacgggggaacgggtaaccctaaagggttccggtaccggtaacccggtttacggaacgggtaccctaacgggaccccgtaaaccgggg

SEQ ID NO: 321927 - DNA, 636 bp, Homo sapiens
  misc_feature: GZ8MTXP02J3CG8.8.14.B03.1.454.CMB.2.raw
  modified_base (308)..(308): a, c, t, g, unknown or other
  misc_feature (308)..(308): n is a, c, g, or t
  modified_base (451)..(451): a, c, t, g, unknown or other
  misc_feature (451)..(451): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgccaccttgcccagtggcatactaatttccattacctttagtgtattattggtatcagcagaacgccgaagggactcccctccccatactcctcctaggaaggtaaataaaacncgaactacgaagaagtaacggagacgacggtcctcgtacggaccgtccccgacgtcccgtcttccgtcgttacggacttaaccgaagcttcggcctaggccggaaccaaagtggacgtaaagggggttctttcgcgttacgtnttccggttcgtcggggtccttaccgttaagggtttggaaagggtgttagggacgggtcttggaaactttagtttagtagttagttgttaagttttacggacgtaggggtcgtcgggtagtttggggagtacgtcggggacggacggacgacgtcgacgtaccggtacgtacgcaccgaccgacgg

SEQ ID NO: 321928 - DNA, 630 bp, Homo sapiens
  misc_feature: GZ8MTXP02HG4JE.8.14.B03.1.454.CMB.2.raw
  modified_base (316)..(316): a, c, t, g, unknown or other
  misc_feature (316)..(316): n is a, c, g, or t
  modified_base (489)..(489): a, c, t, g, unknown or other
  misc_feature (489)..(489): n is a, c, g, or t
  modified_base (556)..(556): a, c, t, g, unknown or other
  misc_feature (556)..(556): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccattacctttagtgtatattggtatcagcagacgccgagggactccctcccactatctccgtagaagtaaataaaacagtactacaagaataagganacgaggtcctgtggaaccgtccccacgtcccgtctttcgtcgtacggaataacccgaagtactcgccgtacgaccgggtaccaaaggtcggtaaccgagggggtttaactttcggcttacacgttcgtcggtcgggtccttacgtaggtttagaggggttatagggacggttnttacggtaacttagtttaagttggtacttggttaacgtttggacgagggtcgtcgtcggtttagggnggtacggtacgggacgggaacgggaacagggtcgtacggtaccggttcgacggtaccacggggacctaaccggg

SEQ ID NO: 321929 - DNA, 659 bp, Homo sapiens
  misc_feature: GZ8MTXP02G06D6.8.14.B03.1.454.CMB.2.raw
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatctaatttccattactttagtgtattattggtatcagcagagcgaggactccctcccatactctcctagaagtaataaacagactacaagaagtaaggagacgacggcctcgtacgggaccgtccccgagcccccgtcttcgtacgtaggaactaccgaaaagcgtcgtcgtcggaccggacctaagtcgacggtagggggtactttcgctacgtacgttccgttcggtcggggtaccttaccggttaggtttagggaacggtacgtagggtaggtcgtttaagtactttaagtttacgtttagtaagttacggtttaggtttacggaacggtaaggggtcgtcgggttagggttggggtacgtacggtcgggggaacgggtacgggaacctaaggtccgtaaccgggtacccgtacggtacggtacgacggtaccccgaggtccccg

SEQ ID NO: 321930 - DNA, 640 bp, Homo sapiens
  misc_feature: GZ8MTXP02HWD5J.8.14.B03.1.454.CMB.2.raw
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcactgcaccttgccagtgcatctaatttcattacttagtgttatattgtatcagcagaagccgaggacgtccctcccatatctctagaagtaataaaacagactacgaagaagtaaaggacgacgacggtcctcgacggaccgtccccgagcccccgtctttcctcgtaggtactaaccgaaagtcgtcgcgtcgaccgtaaccaagtcgacggaagggttcgttcgacctactagttcccgttacggtcgggtccttacgttaggtttagaacgtagtggtacgtcttaagtatttagttagttacgttagtaggttaagtttggaacgtagggtcgtacggttcgggtttagggcgtacggtccgggggaacgggtaacgggaaccctaaggtccggtaacggtacccgtaaccgttacggaccgaccggtacccgtaacggtcccccg

SEQ ID NO: 321931 - DNA, 763 bp, Homo sapiens
  misc_feature: GZ8MTXP02HO2OR.8.14.B03.1.454.CMB.2.raw
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggactcctcccactatctcctgaggtaataaaacagactcagataaggagcaggcctgtggacgtccccacgcccgacttctcgtaggacttaccaaggattcgacttcgaccgggacccaaagtcggaccgtaagggggtaacgttttcggcctttacaacgttccgttaccggtcgggggtccctttacccgtaaggggtttttacggaaaacgggggttcttacggggtaaaggggttccctttaagggtaaacccgttttaaagtttttaactttaggtttaaaagtttgggttaaaccggtttttagggggtaaaccgtaaaagggggtaccgggttacccggggttcggtttttaggggggttacgaaacggggtttccgggggaaccgggggttaacgggggtaaacccccgaaaagggttcccggttaacgggtaaacccccgggttccggttaaaacggggtcccgtaaaacgggaccccccgtttaaaaccggggg

SEQ ID NO: 321932 - DNA, 630 bp, Homo sapiens
  misc_feature: GZ8MTXP02IU5RU.8.14.B03.1.454.CMB.2.raw
  modified_base (360)..(360): a, c, t, g, unknown or other
  misc_feature (360)..(360): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatctaattccattacttagtgtatattgtatcagcagagcgaggactccctcccatatctcctagagtaataaaacagactacaagaagtaaggagacgaggcctcgtcggaccgtccccgagccccgtcttctcgtgactaccgaaagntcgctcgaccgacctaagtcgacggaagggtagtttggcctcattcgtcgtcggggtcttaccggtagtttggaaggtagtgggtacggtacgtttagtaacttttagttagtttagttaagttaggttagttttacggtaacggtaggggtacgtcggttacgggtttggggtaggtaacggttcgggggtacgggaacgggaacctaacgggtctaaccgggtacccgtaacggtacgggtacgaccggtacccgtaacgggtccccg

SEQ ID NO: 321933 - DNA, 615 bp, Homo sapiens
  misc_feature: GZ8MTXP02I6I5B.8.14.B03.1.454.CMB.2.raw
  modified_base (354)..(354): a, c, t, g, unknown or other
  misc_feature (354)..(354): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccattaccttagtgtatattggtatcagcagaagccagggactcctccccatatctcctgagtaataaacagactcagataaggagcaggcctcgtggaccgtccccagccccgtcttctcgtggactaccaaagntgctgccgaccaagtgacgtagggtatttcgctcgattccgtcgtcgggtcttccgtaaggtttggaagtagttggacggtcttagtaactttatttagttagtattggttagtttagggtacgaagggtcgtcgttacggttgggggtatacggggttaccggggacggggtaacggggtaacccgaacggtcgttaaccgggtaaaccccggtttcggacggggttacccgaaccggaccccgtaaaggggttcccccg

SEQ ID NO: 321934 - DNA, 710 bp, Homo sapiens
  misc_feature: GZ8MTXP02ISC3Y.8.14.B03.1.454.CMB.2.raw
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaatttccattacctttagtgtatattgtatcagcagaagccagggactccctccccactactctcctagaagtaaataaaacagactacgaagaagtaaggagcgaacggccctacgtaggaccgtccccgacgtcccgtcctttcgtacgtaggtacctaacccgaagtctacggctccggaccggacctaaagtcggacgtagggttacgtttgacttcgtacttctcggttcgggtccttaccgttaggtttaggaagggttagttaggggacggttacgttagggttaactttttaagtttaagttttgttaaaggtttggtttaacggtttttaggggacgtaaggggtaccggtcgggtttcgggtttagggggttaaggtacgggttaccgggggaaccggggaccgggggttaaccgaaacggttaaccggtacggtaaccccgggttaccgtaacggggttaccgtaaccggaccccggtaacccggg

SEQ ID NO: 321935 - DNA, 608 bp, Homo sapiens
  misc_feature: GZ8MTXP02FKKTF.8.14.B03.1.454.CMB.2.raw
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccattacctttagtgtatattggtatcagcagaagccgaggacgtccctaccccactatcctcctagaaggtaataaaacagactacgagaagtaaggagcgacggcctcgtaggacgtccccagccccgtcttctcgtaggactaccgaaagctcgcgtagaccggacctaagtcgacggtaaggggtagtttcgaccttacctaagttcccgttacggtcggggtccttacccggttagtttaggaggtagtggtaaggtctacgtattattagttgtagttacgtagtttggaacgtagggtacgcggttaggttgggtgtacggtcgggaacgggacggacgagcgtaacgaccgtacggtacgtacgacgaccgaacggtcccg

SEQ ID NO: 321936 - DNA, 691 bp, Homo sapiens
  misc_feature: GZ8MTXP02ILCTB.8.14.B03.1.454.CMB.2.raw
  modified_base (177)..(177): a, c, t, g, unknown or other
  misc_feature (177)..(177): n is a, c, g, or t
  modified_base (407)..(407): a, c, t, g, unknown or other
  misc_feature (407)..(407): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatcctcctggancatcagccaatcgtcactgctaccttgcccagtcggactatactaatttccaattacctttagtgttattagttaggtactcgagcgtaagaacgccgagggtcctcctaccccattactcctacctaggaagttaaacaaacacgtactacgaagtaagtaaagggcacgacggtcctacgtcgggacctaccccgtacgccccgtcttcctcgtaggactacgaaagngttcgacgtacggaccgacctaagtcggtacggtaaggggttcttacgtctactagttccgtcgtaccgggtcttacggttaggttgacggttaatcgggtaacgtacgttacgttaatttagtttagtgtttattaggttaggtttaacggacgtaagggtcgtcgggttacggtttaggggtcgaacggggttcccggggaaagggtaccggaaaaccgtacgtaccggtaaccggtcccggttaccggtacggaccgtacccggaccgtacggttcccccg

SEQ ID NO: 321937 - DNA, 635 bp, Homo sapiens
  misc_feature: GZ8MTXP02IY5K8.8.14.B03.1.454.CMB.2.raw
  modified_base (176)..(176): a, c, t, g, unknown or other
  misc_feature (176)..(176): n is a, c, g, or t
  modified_base (295)..(295): a, c, t, g, unknown or other
  misc_feature (295)..(295): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggancatcagccaatgtcacctgcaccttgcccagtgcatcaatttccattacctttagtgtatattggtatcagcagaagccgagggactcctccccatatcctcctggagtaataaaaacngactacgagaagtaaggagcacggcctcgtacggacgtccccagtcccgtcttcgtcgtaggtaactaccgaaagtgtcgaccgttcggaccggtaccgaaagtcggaacggaggggttaacgtttggacttacgtagttcctcggtacggggtaccttaccgtaggtttggaagggtagtgggtaacggtctagggttaacttaagttagtttgttaagttggtaaagttttgggaacgtaggggtacgtcggttacggttgggtagtacggtcgggacggggtaacggacaacggtcgtacgacccggttacggtaggtccaacggacccgtaacggg

SEQ ID NO: 321938 - DNA, 693 bp, Homo sapiens
  misc_feature: GZ8MTXP02IDKLV.8.14.B03.1.454.CMB.2.raw
  modified_base (200)..(200): a, c, t, g, unknown or other
  misc_feature (200)..(200): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccgcttccctctctgcatctcctggagcatcagccaatgtcacctgcacttncccagtgcatctaatttccattacctttagtgttatagttggtatcagcaagaacgccgagggacgtcccctaccccactactcctccgtaggaacgttaaataaaacgaacgaccttacgaaaggtaagtaaacgggataccgacggtcccctcggtacggtaccgttacccccgacggcccccgtcgtttcctcgtacggaacttaacccaaaagtcgttcgacgttcggaccgaccctaaaggtcgtacggtaaggggttagtttcggtacctcgacgttccgttcgtccgggtcttacccgttaaggttggaaggtaggtggaaggtcgttagtatttagtttaagttggttaaagttggttagtttaggtacgtagggtacgtccggttcggttagggtggtacgggtcggggaacgggacgggaaaccacggtacgtaacggtaccggttaccgtacggtaccggaccggacccgaaacggtccccg

SEQ ID NO: 321939 - DNA, 733 bp, Homo sapiens
  misc_feature: GZ8MTXP02HJ1A4.8.14.B03.1.454.CMB.2.raw
  modified_base (177)..(177): a, c, t, g, unknown or other
  misc_feature (177)..(177): n is a, c, g, or t
  modified_base (268)..(268): a, c, t, g, unknown or other
  misc_feature (268)..(268): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggctttccctctctgcatctcctggancatcagccaatgtcacctgcaccttgcccagtggcatctaactttccattacctttagtgtatattgtatcagcagacgcagggtactccncccatatctcctagagtaataaacagactcaagtaagtaaggacgcacggcctcgtcggaccgtccccagcccgtcttctcgtacggactacgaagcgttcgcgtccggacggacctaaagttcggacgggttaggggttacgttttcgaccttacgttaacgttcccgttcggtcggggtcccttaaccggttaggtttacgggaaacggtcgttagggtaacggggtttctaagggtaaccttttaaagtttacgtttaaggttaaggtcggtttttaaaaggttttacgggaaaccgtagggggttaaccgtaccgggttacggggtttttaggggacggtttaacgggggtaccccgggggtaagggggaaacccgggggttaaaaccaaagggttccccgttaaggggaaccccgtttaccgtaacgggggttacacccgggtttaaccccgtaacgggg

SEQ ID NO: 321940 - DNA, 681 bp, Homo sapiens
  misc_feature: GZ8MTXP02G3J6A.8.14.B03.1.454.CMB.2.raw
  modified_base (161)..(161): a, c, t, g, unknown or other
  misc_feature (161)..(161): n is a, c, g, or t
  modified_base (234)..(234): a, c, t, g, unknown or other
  misc_feature (234)..(234): n is a, c, g, or t
  modified_base (296)..(296): a, c, t, g, unknown or other
  misc_feature (296)..(296): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttcccctctcgcagactgtgctgactcagccggcttccctntctgcatctcctggagcatcagccaatgtcactgccacttgcccagtgcatctaatttccattacctttagtnttatattggtatcagacagaacgcgagggctccctcccatctctctagaagtaaataaaacngactacgaagaagtaaggcacgaggtccctgtcggaccgtccccgagccgtcttcgtcgtacggactaccaagtcgtacgcgtacgccggtacaacgtcgggacgtaaggggtttacgtttcgacttaccgtagttcccggtacggttcggggtccctttacggttagggtttagaagggttcgtaggacgggtttactacgttaagtttaagtttagttaggttagtttaggtttaaaggtttaccggagtaaacggggcgttaccgggttgggttagggggtaccgtaggggttacccgggggaacggggtaccggtaaccgtaaggaacccgtaccggtaaccggttaccgtaggtacccggaccgaccccggttaaccggg

SEQ ID NO: 321941 - DNA, 588 bp, Homo sapiens
  misc_feature: GZ8MTXP02G9HDO.8.14.B03.1.454.CMB.2.raw
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (360)..(360): a, c, t, g, unknown or other
  misc_feature (360)..(360): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgccagtgcatcaatttccattacctttagtgtatattggtatcagcagaagccgagggactccctccccactatctcctagagtaataaaacagactanagaataaggancacggcctcgtacggacgtccccagccgtcttctctggactaccaagtntgacgtgaccggacaagtcgacgagggtagtttcgctcacttcgtcgtcgggtcctacgtaggttgaggtattgggacgtctagtacttattagttgtaagttgttaagtttacggaaggtaagggcggtcgtaggttggggtacgtaacgggtcggggacggggaaacgggaccgaaaggtccgtacggtacccgtacggttacggaccaccggtacccgaaccggg

SEQ ID NO: 321942 - DNA, 682 bp, Homo sapiens
  misc_feature: GZ8MTXP02HC45C.8.14.B03.1.454.CMB.2.raw
  modified_base (235)..(235): a, c, t, g, unknown or other
  misc_feature (235)..(235): n is a, c, g, or t
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgccagtgcatctaatttccattacttagtgtatnttggtatcagcagagcgaggactcccnccctatactctccgagaggtaataaaacagactacaagaagtaaagganacaggtccctcgtacggacctaccccgagcccccgtacttcgtcgtacggactaccgaaaagggtctcgcgtacggaccgtaacccgtaagttcgggaaccgtagggggttattttccggcttcggtaattcccgtacggtcggggtcccttacggtaaggtttcggaaaggtgttaaccggggcgttacgttagttaactttaaggtttagttaaggttattaggtttaggttaccggtaaggacgggtacggtcggttagggttagggtacggtacggggtacggggaacggggtaaacgtaaccgtacggttaccggtaaccgttacccggtaacgtacgggtacccgaccggaccggtaacggtccc

SEQ ID NO: 321943 - DNA, 499 bp, Homo sapiens
  misc_feature: GZ8MTXP02H2B3W.8.14.B03.1.454.CMB.2.raw
  modified_base (176)..(176): a, c, t, g, unknown or other
  misc_feature (176)..(176): n is a, c, g, or t
  modified_base (229)..(229): a, c, t, g, unknown or other
  misc_feature (229)..(229): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
  modified_base (372)..(375): a, c, t, g, unknown or other
  misc_feature (372)..(375): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggancatcagccaatgtcacctgcaccttgcccagtgcatcaatttcatactttagngtatattggtatcagcagaagccaggacgtcctccccatatctccagaggtaanaaacngactnaagataaaggngcaggcctcgtggacctccccagcccgcttactctggataccgaantgctgccgcaatgcagggtntnnnntctgngcgtcgtgtgngangagcgtatatattagttgtatagtagttagtagagagcgtcgtggtgacgtcggacggacggaacgacgacgtcgtaccgtacgtacgtacgacgaccgacgccg

SEQ ID NO: 321944 - DNA, 571 bp, Homo sapiens
  misc_feature: GZ8MTXP02H1V3U.8.14.B03.1.454.CMB.2.raw
  modified_base (233)..(233): a, c, t, g, unknown or other
  misc_feature (233)..(233): n is a, c, g, or t
  modified_base (295)..(295): a, c, t, g, unknown or other
  misc_feature (295)..(295): n is a, c, g, or t
  modified_base (355)..(355): a, c, t, g, unknown or other
  misc_feature (355)..(355): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaaatttccatacctttagngttatattggtatcagcagaagccagggacgtcctccccatatctcctgaggtaataaaacngactacagataaggagcaggcctctggactccccagccccgcttctctggataccaaagntgctcggcgccaatgcaggggtattgctcactctcgtcgggtactccgtagtttagaggtatggaaggcgttgtacttattagttgttaagtgttagtttaggtagaggtaggtccgtcggttggggtagtacggtcggggacgggaacggggaccaaaggtccgtaacggaacccggtcgttacgggtacgaaccggccccgaaaagggtccccg

SEQ ID NO: 321945 - DNA, 682 bp, Homo sapiens
  misc_feature: GZ8MTXP02IMPKX.8.14.B03.1.454.CMB.2.raw
  modified_base (234)..(234): a, c, t, g, unknown or other
  misc_feature (234)..(234): n is a, c, g, or t
  modified_base (292)..(292): a, c, t, g, unknown or other
  misc_feature (292)..(292): n is a, c, g, or t
  modified_base (562)..(562): a, c, t, g, unknown or other
  misc_feature (562)..(562): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctccgtggagcatcagccaatgtcacctgccaccttgcccagtgcatcaatttccattacctttagngtatattggtatcagcagaagccgagggcgtccctccccatatcctcctagaagtaanaaaacagactagaagaagtaaagggacacgacggtcctcgtacgggtaccgtacccccgaggtcccccgtcctttccgtacgtacggtactaacccgaaaaagtcgtcggacgtcgggaccggacccgtaaagttcgggacggtaaggggttagtttccggtctacgtacgttcgtcggtcgggtacctaccgttaggtttaggaggtagtggacggcttaagactttagtttataggtttacgtagttaggtttaaggacgtaaggggngtccggttacgggtttgggggtaagcgggtttacgggggacgggtaaaccggggtaacccaaggtccgtaaccggtaccggtaccggttacggctaacccggaccggtaacgggtccccg

SEQ ID NO: 321946 - DNA, 624 bp, Homo sapiens
  misc_feature: GZ8MTXP02JUAYC.8.14.B03.1.454.CMB.2.raw
  modified_base (444)..(444): a, c, t, g, unknown or other
  misc_feature (444)..(444): n is a, c, g, or t
  modified_base (553)..(553): a, c, t, g, unknown or other
  misc_feature (553)..(553): n is a, c, g, or t
tcagctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatctaatttccattacttagtgttattattggtatcgagctaagaagccgagggtacgtccctccccatactcctccgtagaaggtaataaaacgaggtactacaagaagtaaggagacgaacggtcctacgttacgggaccgtcccccgaagtcccccgtcgtttaccgtcgtagggacttaccgaaaagtcgtcgacttcggaccgggacccaaagtcggacgtaaggggtnttttcgactctacgttcgtacgtgggactaccgtagttgagtagcggagtctagtacttagttagttgttactggttagtttggaccgtaggtacgcgttcgttggggnacggtcgggtaccggggagaccctaaggcgtaacggacccgtttacggacgtcgaccgaccggacgtcccg

SEQ ID NO: 321947 - DNA, 613 bp, Homo sapiens
  misc_feature: GZ8MTXP02JAMIT.8.14.B03.1.454.CMB.2.raw
  modified_base (293)..(293): a, c, t, g, unknown or other
  misc_feature (293)..(293): n is a, c, g, or t
  modified_base (363)..(363): a, c, t, g, unknown or other
  misc_feature (363)..(363): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatctaattccattacctttagtgtatattggtatcagcagacgcagggacgtcctcccactactcctctgagtaataaacganactacaagaagtaaggagcgagcctcgtcggacgtccccgacgcccgtcgttctctaggactaccaagtntcgacgtcgacgaccgagtcgacgtagggtagtttcgcttcattcgtcggttcggccttacgtaggtttagacggtagtgacgggtcttaggttattagtttagttagtatacggttagtttagggtaagtacgggtagtcggtacgggtttaggggtgggtacggttaccgggacgggggtaacggaaccgtaacgggtccgttaccgggaccggttacgtaacgggtccgtacggtacccgggaaccg

SEQ ID NO: 321948 - DNA, 565 bp, Homo sapiens
  misc_feature: GZ8MTXP02HEUMU.8.14.B03.1.454.CMB.2.raw
  modified_base (231)..(231): a, c, t, g, unknown or other
  misc_feature (231)..(231): n is a, c, g, or t
  modified_base (283)..(283): a, c, t, g, unknown or other
  misc_feature (283)..(283): n is a, c, g, or t
  modified_base (305)..(305): a, c, t, g, unknown or other
  misc_feature (305)..(305): n is a, c, g, or t
  modified_base (412)..(412): a, c, t, g, unknown or other
  misc_feature (412)..(412): n is a, c, g, or t
  modified_base (441)..(441): a, c, t, g, unknown or other
  misc_feature (441)..(441): n is a, c, g, or t
tcagctcgcgtgtccacgaccggtgctcgatttagtgtgagtagtactgcggggggtaagaggttgtgtccaccatggcctggactcctctcctcctcctgttcctctctcactgcacaggttccctctcgcagactgtgctgactcagccggcttccctctctgcatctcctggagcatcagccaatgtcactgcaccttgccagtgcatcaattccattacctttagtntatattggtatcagcagaagcgagggatccctcccactatctcctagagtanaaaacagactacagataagganacgaggcctacgtaggactaccccgacgccgtacttctcgtggaacttaccaagacttcgcgtagccggaccaaagtcgacgaggggtagtttgcttacagtctcgnggtactcgtagttcggagtagtgacggtntagtattaattagttagtagttagtacgttggtagaggtcggtacgttggtgggtacgtacggacgggacgggtaacggacgtagtccgtacgtaccggtcgtacggtccgaacggtaccgacg

SEQ ID NO: 321949 - DNA, 598 bp, Homo sapiens
  misc_feature: GZ8MTXP02IRAON.8.14.B03.1.454.CMB.2.raw
  modified_base (228)..(228): a, c, t, g, unknown or other
  misc_feature (228)..(228): n is a, c, g, or t
  modified_base (392)..(392): a, c, t, g, unknown or other
  misc_feature (392)..(392): n is a, c, g, or t
  modified_base (522)..(522): a, c, t, g, unknown or other
  misc_feature (522)..(522): n is a, c, g, or t
tcagctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtgcatcaattcatacttagtntatattgtatcagcagaagccagggatccctcccactatctctgaggtaataaaacagactacagaataaggaagcaaggtcctcgtaggacgtccctaacgccgtcttctcttggaacttccaagatgctagaccggccaaagttgcgtaaggggtactttgnttaccaatcttcgtacgggctacccgtaggtttacgaagggtatagaacgggtcttagggaccttaagtttaattgggttaacttgggtactttttacgggaaagtagggaacgtccgtaggttttgggnggtaaaccgtcggggacggaacgggtaccgaaagcgttacgaaccgtccgttaagcccgtaaggaccccgaaaggg

SEQ ID NO: 321950 - DNA, 511 bp, Homo sapiens
  misc_feature: GZ8MTXP01EV844.39.80.H03.1.454.CMB.2.raw
  modified_base (301)..(301): a, c, t, g, unknown or other
  misc_feature (301)..(301): n is a, c, g, or t
  modified_base (319)..(319): a, c, t, g, unknown or other
  misc_feature (319)..(319): n is a, c, g, or t
  modified_base (448)..(448): a, c, t, g, unknown or other
  misc_feature (448)..(448): n is a, c, g, or t
tcagtcgcactagtcacgaccggtgctcgatttagctgtgcgtcgaagggaaagggggtctcaggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatctcctgcactggaaccagcagtgacattggtagtgataactatgtctcctggtaccaaacaatacccaggaacgcccccaaatcatcatttangagtcaataatcggcctnagggatttctgatcgcttctctgctccaagtctggcaacacggcctccctgaccatctctgggctccgaggatggaggacgaggctgattagttactgctactcatttcgaaaggtgcaagccaccctntcggttcttcggcggagggccaagggttcgaccgtccttggcagcccaaggtcttcgcccccg

SEQ ID NO: 321951 - DNA, 596 bp, Homo sapiens
  misc_feature: GZ8MTXP01DLYIM.39.80.H03.1.454.CMB.2.raw
  modified_base (300)..(300): a, c, t, g, unknown or other
  misc_feature (300)..(300): n is a, c, g, or t
tcagtcgcactagtcacgaccggtgctcgatttagctgtgcgtcgaagggaaagggggggtctcaggaggcagcgctctcaggacatctccaccatggcctggactctgctgctcctcaccctcctcactcagggcacagggtcctgggcccagtctggcctgactcagcctgcctcgtgtctgggtctcctggacagtcgatcaccatctcctgcactggaaaccagcagtgacattggagtgataactatgtctctggtaccaacaatacccaggaacgcccccaaatcatcatttangagtacaataatcggcctcaggtatttctgatcgcttctctggccttccgaaagttcctgggaccaaaccgaccgggtccctcccctagaccctatcctcgtgggcctaccgaggatggaaggacgaggctagaatttattaacgtgaccttatctagtttacgaaaggctcaacgccctaaccccttgtcggttccgttcgggcgggaacggggtacccaaaggggttcgaaccccggttccgtttggggtaacccaacgggcccccgaaagggtcccgttccggtccccccccg

SEQ ID NO: 321952 - DNA, 671 bp, Homo sapiens
  misc_feature: GZ8MTXP01A7KGN.39.80.H03.1.454.CMB.2.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (310)..(310): a, c, t, g, unknown or other
  misc_feature (310)..(310): n is a, c, g, or t
tcagtcgcactagtcacgaccggtgctcgatttagctgtgcgtcgaagggaaaggggggggtctcaggaggcagcgctctcaggacatctccaccatggcctggactctgctgctcctcaccctcctcactcagggcacagggtcctgggcccagtctggcctgactcagcctgcctccgtgtctggtctcctggacagtcatcacatctctgcactggaaccngcagtnactagttggtagtgataactatgtctccgtagtaaccaaacaactacccgagggaaccgacccccaaatcatcaatttangagtacaataactccggacctcgaggtactttctacgtactcgtctttctcgtacggtcccttccgaaagttccgtacgggacccaaaccggtacccgggtccccttaccccgtacgtaccctacgttcccgtccggtacgggtcccttacccggaacggtagtacgggaacgggacgacggtcgttagtaactttacgttactcgaccttactacgtagtttacggaacgcgtaccacgtaccctacccgttgtcggttccgttcgggaccggtaacgggaccgttaacgggttccgacccggtttaaccgttcggaaccgtaccggacccgttaacggtcccgttaaccggtccccccg

SEQ ID NO: 321953 - DNA, 544 bp, Homo sapiens
  misc_feature: GZ8MTXP01C6V5Q.39.80.H03.1.454.CMB.2.raw
  modified_base (226)..(226): a, c, t, g, unknown or other
  misc_feature (226)..(226): n is a, c, g, or t
  modified_base (313)..(313): a, c, t, g, unknown or other
  misc_feature (313)..(313): n is a, c, g, or t
tcagtcgcactagtcacgaccggtgctcgatttagctgtgcgtcgaagggaaagggggggtctcaggaggcagcgctctcaggacatctccaccatggcctggactctgctgctcctcaccctcctcactcagggcacagggtcctgggcccagtctggcctgactcagcctgcctcgtgtctggtctcctggacagtcgatcaccatctcctgcactggaaaccngcagtgaactagttggtagtgataactatgtctctgtaccaacaatacccaggaacgccccaaatcatcatttatgagtcaattaanccggcctgaggtatttctgatcgtcttctctgctccaagtctggcaacgacggcctcctgaccatctcgtcgggcctaccgaggtatggaggacgaggctgtaatttacttactcgacttaatcgtagtttacgaagtgccaagcccaccccttgtcggttcgttcgggcggaacgggaccttaagggttcgaccgttcgttcgcgacggcccgaggtccgccgtcccccg

SEQ ID NO: 321954 - DNA, 527 bp, Homo sapiens
  misc_feature: GZ8MTXP01EI8OZ.39.80.H03.1.454.CMB.2.raw
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
tcagtcgcactagtcacgaccggtgctcgatttagctgtgcgtcgaagggaaagggggggtctcaggaggcagcgctctcaggacatctccaccatggcctggactctgctgctcctcaccctcctcactcagggcacagggtcctgggcccagtctggcctgactcagcctgcctcgtgtctgggtctcctggacagtcatcacatctcctgcactggaaccagcagtgactagttggatgataactatgtctctggtaaccaaacaatacccaggaacgcccccaaatcatcattangagtcaataancggcctnaggatttctagatcgcttctctgctcaagtctggcaacncggcctccctgaccatcnctaacgctccaggctgaggacgaggctagactattatgacagtcctatattactagtagaagtcaagtggtaacttcccgtaacttgggccttggttcgggcgttaggggaaccctaaggttcgaccgttcgttacggtccaaggtaaccccg

SEQ ID NO: 321955 - DNA, 656 bp, Homo sapiens
  misc_feature: GZ8MTXP01DWMN6.39.80.H03.1.454.CMB.2.raw
  modified_base (227)..(227): a, c, t, g, unknown or other
  misc_feature (227)..(227): n is a, c, g, or t
tcagtcgcactagtcacgaccggtgctcgatttagctgtgcgtcgaagggaaaggggggggtctcaggaggcagcgctctcaggacatctccaccatggcctggactctgctgctcctcacccctcctcactcagggcacagggtcctgggcccagtctggcctgactcagcctgcctcgtgtctgggtctcctggacagtcatcaccatctcctgcactggaaccngcagtgaactagttggtagtgattaactatgtctcctggtaaccaaacaaactacccgaagggaacgacccccaaactcaactacatttatagaggtacaaattaatccgggcccttacgaggggtactttctagacttcgtcttctctcggcctcaagtctcggacaaccgacggtccctccctcgtacctactcctcgtcgggtcctacccgaggtactagggaacggaacgaggtacttaggtaacgtttaagtttaactcgtactttaaccttacgtaacgttttacggaaaacgggcgtaccgaacggtccctaaccccgttcgttcggttccggttccggggacgggacgggtacccgttaaaggggttcgttaacccggttcgttacggtccgaacggcccgaggtcccgttcccgtccccg

SEQ ID NO: 321956 - DNA, 689 bp, Homo sapiens
  misc_feature: GZ8MTXP01DR7QF.39.80.H03.1.454.CMB.2.raw
tcagtcgcactagtcacgaccggtgctcgatttagctgtgcgtcgaagggaaaggggggggtctcaggaggcagcgctctcaggacatctccaccatggcctggactctgctgctcctcaccctcctcactcagggcacagggtcctgggcccagtctggcctgactcagcctgcctcgtgtctgggtctccgtggacagtcgatcacatctcctgcactggaaccagcagtgactagttggagtgataactatgtctcctaggtaaccaaacaactaacccgaagggaacgacccccaaaactcaatcctaatttatagtacggtacaaagttaaagtccggtacccttcgaaggggttactttcgtacgattcgtctttctcgtaggtcctccgaaagtccgtaggaccaaccgaccgggccctaccctcgaaccctacttccgtcgttcgggcccgttaccgaagggtagtacgggaacgggaccgagggtaccgttaggtaacgtttaactttacgtcgtaccttacgtactagtttaacggaaaggacgacgtacgccctaacccccgttcgttcgggttccgttccggggacgggtaaccggggaacccgttacgggttccggttacccgttcccgtttacggaaccgaccggtcccgaacggtcccgttccgtcccccccgg

SEQ ID NO: 321957 - DNA, 669 bp, Homo sapiens
  misc_feature: GZ8MTXP01BIED5.39.80.H03.1.454.CMB.2.raw
  modified_base (229)..(229): a, c, t, g, unknown or other
  misc_feature (229)..(229): n is a, c, g, or t
  modified_base (314)..(314): a, c, t, g, unknown or other
  misc_feature (314)..(314): n is a, c, g, or t
tcagtcgcactagtcacgaccggtgctcgatttagctgtgcgtcgaaggggaaaggggggggtctcaggaggcagcgctctcaggacatctccaccatggcctggactctgctgctcctcaccctcctcactcagggcacagggtcctgggcccagtctggcctgactcagcctgcctcgtgtctggtctccgtggacagtcatcacctatctcctgcacgtggaaccngcagtgactagtttggtagtagataactatgtctctagtaaccaacaactacccgaagggaacgacccccaaatcatctatttangtagtacaataacgtcggacctcgaggtatttcgtgtatcgtcttctcgtacggcctcgaagtcgtacggacctaacgaccggccctccctacgacctacttccgtcgtcgggcctacgacggtctaggacggacgacggtcttcttacgttaatttgttcacgtatccttactaaattaacttaacaaacgtacttaaacgtttacgtaaccgttaacgggttttcgggggtcggtttaccggggaccgggggtaaaccgggggttaaccccgttaccgttacggtaaccccggtttccgggtttaacggaccgtacccggggaacccctaagggggttccccttcccccgggg

SEQ ID NO: 321958 - DNA, 592 bp, Homo sapiens
  misc_feature: GZ8MTXP01BXMJ1.39.80.H03.1.454.CMB.2.raw
  modified_base (226)..(226): a, c, t, g, unknown or other
  misc_feature (226)..(226): n is a, c, g, or t
  modified_base (321)..(321): a, c, t, g, unknown or other
  misc_feature (321)..(321): n is a, c, g, or t
tcagtcgcactagtcacgaccggtgctcgatttagctgtgcgtcgaagggaaagggggggtctcaggaggcagcgctctcaggacatctccaccatggcctggactctgctgctcctcaccctcctcactcagggcacagggtcctgggcccagtctggcctgactcagcctgcctccgtgtctggtctcctggacagtcgatcaccatctcctgcactggaaccngcagtgacagtttggtagtgataactatgtctctggtaccaacatacccaggaacgcccccaaatcatcatttatgaggtcaataatcggccctnagggtattctgatcgtcttctctggtcctcaaagtctgggacacaccggcctaccctcgaccatcctctcgggtcctaccgaggtactggacgggacgaggcttagatttacttacgttgctacgtcctagtttcgaaagggtcacgtaacgtcccaaccccgttcgtcgggttcgttccgggacgggtacggggtaaccgaacgggttcgttaacccggttccgtttcgggtccacggccccgttaaggtcccgttaaccgtccccccgg

SEQ ID NO: 321959 - DNA, 704 bp, Homo sapiens
  misc_feature: GZ8MTXP01CLNJT.39.80.H03.1.454.CMB.2.raw
  modified_base (227)..(227): a, c, t, g, unknown or other
  misc_feature (227)..(227): n is a, c, g, or t
  modified_base (323)..(323): a, c, t, g, unknown or other
  misc_feature (323)..(323): n is a, c, g, or t
  modified_base (365)..(365): a, c, t, g, unknown or other
  misc_feature (365)..(365): n is a, c, g, or t
tcagtcgcactagtcacgaccggtgctcgatttagctgtgcgtcgaagggaaaggggggggtctcaggaggcagcgctctcaggacatctccaccatggcctggactctgctgctcctcaccctctcactcagggcacgagggtcctgggcccagtctggcctgactcagcctgcctccgtgtctggtctccgtggacagtcgatcaccatctctgcactggaaccngcagtgactagttggtagtgaataactatcgtctcctagtaaccaaactaacgtaccccgaagggaaccgacccccaaactcagtactaatttagngtaacgtactaagttaactccggaccctagaaggtactttcncgtatacgtcgtttctacgtcggtacctcgaaagttccgtgaccaaccaccgggtcccttacccgtacgaccctattccgtacgtcggtcctacgtacggtactacggacggacgtacggtacttacgttaggtttaacttacggttcctactttaccgtacgttaacgtttacggaaacggtacgtaccgacgtaccctaaccccgttcgttccgggttaccgttacggggacgggtaaaccggggtaccgttaaacgggttccggttacccgttaaccggtttccggaacgtacccggtacccggttaaaccggtccgttaaccccggttcccccgg

SEQ ID NO: 321960 - DNA, 668 bp, Homo sapiens
  misc_feature: GZ8MTXP01DQVQQ.39.80.H03.1.454.CMB.2.raw
  modified_base (323)..(323): a, c, t, g, unknown or other
  misc_feature (323)..(323): n is a, c, g, or t
  modified_base (352)..(352): a, c, t, g, unknown or other
  misc_feature (352)..(352): n is a, c, g, or t
tcagtcgcactagtcacgaccggtgctcgatttagctgtgcgtcgaaggggaaaggggggggtctcaggaggcagcgctctcaggacatctccaccatggcctggactctgctgctcctcaccctcctcactcaggcacagggtcctgggcccagtctggcctgactcagcctgcctccgtgtctggtctcctggacagtcatcaccatctcctgcactggaaccagctagtgactagttaggtagtagtaataactatcgtctactacggtaaccaaacaactaacccgaacgggaaccgacccccaaatcatactatttanagagtacaataactccggacctagaggtntttcgtacgactcgtcttctcgtcgtcctcgagtcgtacggaccaaccgtaccggtccctcccgtacgtaccctacttccgtcgtcggtcctaccgaggagtacgggaacggacgaaggtcttaagtaactttaacgttacgtacgtaccttaacctacgttaacgtttaacggaaaacggcgtacccgacggtacccctacccggttcgttcgggttcccggttaccggggacgggaaacggtacgttaacgggttccgttacccggttcgttcggaacctacggacccgttacggtcccgttcccggtcccccg

SEQ ID NO: 321961 - DNA, 501 bp, Homo sapiens
  misc_feature: GZ8MTXP02HG23U.39.80.H03.1.454.CMB.2.raw
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (375)..(375): a, c, t, g, unknown or other
  misc_feature (375)..(375): n is a, c, g, or t
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
  modified_base (459)..(459): a, c, t, g, unknown or other
  misc_feature (459)..(459): n is a, c, g, or t
tcagtcgcactagtcacgaccggtgctcgatttagctgtgcgtcgaagggaaagggggtctcaggaggcagcgctctcaggacatctccaccatggcctggactctgctgctcctcaccctcctcactcagggcacagggtcctgggcccagtctggcctgactcagcctgcctcgtgtctgggtctcctggacagtcgatcaccatctcctgcactggaaccagcagtgacattggtagtgataaactatgtctcctggtaacccaanaatacccagggaacgcccccaaatcatcatttangagtcaatactcggccctnaggtatttcngatcgcttctcgtgctccaaagttctggcaacacggcctcccngaccatctctggctcgagatgaggacgaggctgattattactgctactcatttcgaagngcagcacccctntcggtcttccggnggacggacaggtcgaccgtcgtgtcacgccaagctcgccccg

SEQ ID NO: 321962 - DNA, 517 bp, Homo sapiens
  misc_feature: GZ8MTXP02GGTZ5.39.80.H03.1.454.CMB.2.raw
  modified_base (299)..(299): a, c, t, g, unknown or other
  misc_feature (299)..(299): n is a, c, g, or t
  modified_base (331)..(331): a, c, t, g, unknown or other
  misc_feature (331)..(331): n is a, c, g, or t
  modified_base (406)..(406): a, c, t, g, unknown or other
  misc_feature (406)..(406): n is a, c, g, or t
  modified_base (437)..(437): a, c, t, g, unknown or other
  misc_feature (437)..(437): n is a, c, g, or t
tcagtcgcactagtcacgaccggtgctcgatttagctgtgcgtcgaagggaaagggggtctcaggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatctcctgcactggaaccagcagtgacattggagtgataactatgtctcctggtaccaacaatacccaggaacgcccccaaatcatcatttangagtcaaataatcggccctcgagggtatttcngatcgcttctctggctccaagtctggacaacacggccctccctagaccatctctgggctccgaggatgaggacgnggctgattatactgactactcatttcgaagngcagcacccctctcggtcttcggcggtaggacctaaggtcgaacgtccgttggtacacggcccaaggcctcggtcccccg

SEQ ID NO: 321963 - DNA, 604 bp, Homo sapiens
  misc_feature: GZ8MTXP02HVS12.39.80.H03.1.454.CMB.2.raw
  modified_base (304)..(304): a, c, t, g, unknown or other
  misc_feature (304)..(304): n is a, c, g, or t
tcagtcgcactagtcacgaccggtgctcgatttagctgtgcgtcgaagggaaaggggggtctcaggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatctcctgcactggaaccagcaagtgacattggtagtgataactatgtctcctggtaaccaacaataccccaggaacgcccccaaatcatcatttangagtcaataatcggcctgaggtattctgatcgcttctctggctccagtctggcaacgacggcctccctgacccatctcgtcgggcctaccgaggtatggaacgggaacggcggtacttagttaatttacgttacgtcgtacctacttacgtacgttacggaaaggtacgaccgacgtaccctacccgttcggttacggttccgttccgggacgggtaaccgggtaaccgtaacgggtccgtacccggttccgttacggtaccgaccggtaccccgtaacggtcccgtacccggtcccccg

SEQ ID NO: 321964 - DNA, 500 bp, Homo sapiens
  misc_feature: GZ8MTXP02JJNIA.39.80.H03.1.454.CMB.2.raw
  modified_base (225)..(225): a, c, t, g, unknown or other
  misc_feature (225)..(225): n is a, c, g, or t
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
tcagtcgcactagtcacgaccggtgctcgatttagctgtgcgtcgaagggaaagggggtctcaggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatctcctgcactggaaccngcagtgacattggtagtgataactatgtctctggtaccaacaatacccaggaacgccccaaactcatcatttangagtcaatatcggccctcaggtatttcngatcgcttctctggctccaagtctggacaacacggccctccctgacccatctctgggcctccgaggatgaggacgaggctgaattatactgctatcatttcgaagngcagcacccctntggtctcggcgacggtaccaaggtcacgtcgtggcacgccaaggcctcgtccccg

SEQ ID NO: 321965 - DNA, 550 bp, Homo sapiens
  misc_feature: GZ8MTXP02G339O.39.80.H03.1.454.CMB.2.raw
  modified_base (226)..(226): a, c, t, g, unknown or other
  misc_feature (226)..(226): n is a, c, g, or t
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
  modified_base (378)..(378): a, c, t, g, unknown or other
  misc_feature (378)..(378): n is a, c, g, or t
  modified_base (416)..(416): a, c, t, g, unknown or other
  misc_feature (416)..(416): n is a, c, g, or t
tcagtcgcactagtcacgaccggtgctcgatttagctgtgcgtcgaagggaaaggggggtctcaggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatctcctgcactggaaccngcagtgacattggtagtgataactatgtctcctggtaccaacaatacccaggaacgccccaaactcatcatttangagtcaataatcgcctnaggatttcnatcgcttctctgctccaagtctggacaacacggcctccctgaccatctcgngggcctcgaggtctggacgacgaggctgattagttacngtcctactctaatttcggaaaggacgtcaagtccaaccccttcgtacggttcttcgggcggaaacggggaccctaaaggggttcgaacccgtcgtttcggacacggaccccaacggggtcctacggtccccccg

SEQ ID NO: 321966 - DNA, 532 bp, Homo sapiens
  misc_feature: GZ8MTXP02I1Y17.39.80.H03.1.454.CMB.2.raw
  modified_base (228)..(228): a, c, t, g, unknown or other
  misc_feature (228)..(228): n is a, c, g, or t
  modified_base (306)..(306): a, c, t, g, unknown or other
  misc_feature (306)..(306): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (414)..(414): a, c, t, g, unknown or other
  misc_feature (414)..(414): n is a, c, g, or t
  modified_base (453)..(453): a, c, t, g, unknown or other
  misc_feature (453)..(453): n is a, c, g, or t
tcagtcgcactagtcacgaccggtgctcgatttagctgtgcgtcgaagggaaagggggggtctcaggaggcagcgctctcaggacatctccaccatggcctggactctgctgctccctcaccctcctcactcagggcacagggtcctgggcccagtctggcctgactcagcctgcctccgtgtctgggtctcctggacagtcgatcaccatctcctgcactggaaccngcagtgacagttggtagtgataactatgtctcctggtaccaacaactacccgagggaacgccccaaatcatcatttangagtcaatatcgccctnaggtatttcngatcgcttctctcgctccaagtctggaccaacgacggccctccctagacctatctcgtgggtctccgaggatggaggacgnggactagtattattactgtctactctagtttacgagacncacgcctcctcgtcgtcgtcggacggacggacgtacggtcgtaccgtcgtcggtacgacgaccgacgccgtccgtcccg

SEQ ID NO: 321967 - DNA, 637 bp, Homo sapiens
  misc_feature: GZ8MTXP02IO0GN.39.80.H03.1.454.CMB.2.raw
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
tcagtcgcactagtcacgaccggtgctcgatttagctgtgcgtcgaagggaaagggggggtctcaggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatctcctgcactggaaccagcagtgacattggtagtgataactatgtctcctgtaaccaacaatacccgaggaacgaccccaaactcatcattatgagtacaatatcggcctacaggtnttctgatcgcttcnccgctccagtctggaccaacgaccgtccctccctgaccctatcctcctaacgaccttcccgaaggtcctagaacgggaccgagggtcctaggtaacctttaagtttaactttcggacctaggtaccttactaatttaactaacctagggtaaaacgttacctaaaaggttacggttaactacccctaaacggtttcgggtaccttgggtttacccggggaccgggtaacggggtaaccctaaggtttccggaaacccgttcccgttaaggggcccctaacggaccccgtaaacggg

SEQ ID NO: 321968 - DNA, 611 bp, Homo sapiens
  misc_feature: GZ8MTXP02HRBQC.39.80.H03.1.454.CMB.2.raw
  modified_base (228)..(228): a, c, t, g, unknown or other
  misc_feature (228)..(228): n is a, c, g, or t
tcagtcgcactagtcacgaccggtgctcgatttagctgtgcgtcgaaagggaaagggggggtctcaggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatctcctgcactggaaccngcagtgacagttggtagtgataactatgtctctgtaaccaacaactacccgaggaacgaccccaaactcatcattatgagtacaataatcggccctagaggtatttcgtgtatcgtcttctcgtcggctccgaagtctaggccaacgaccggtcctccctgaccctactcctcgtcgggcctccgaggatcggaaggacgaggtcttagtatttacttacgtgtaccttactacgtagtttaccggaaggacgacaacgtcccttaacccgtttcgtcgggtttccgtccggggacgggtaacgggaaccccgtaagggtccgtaacccggtttccgttacgggtacgtaccggacccgtaacggtcccgtccggtccccccg

SEQ ID NO: 321969 - DNA, 574 bp, Homo sapiens
  misc_feature: GZ8MTXP02JGO2J.39.80.H03.1.454.CMB.2.raw
  modified_base (304)..(304): a, c, t, g, unknown or other
  misc_feature (304)..(304): n is a, c, g, or t
  modified_base (413)..(413): a, c, t, g, unknown or other
  misc_feature (413)..(413): n is a, c, g, or t
tcagtcgcactagtcacgaccggtgctcgatttagctgtgcgtcgaagggaaagggggggtctcaggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatctcctgcactggaaccagcagtgacggttggggtatgactatgtctctggtaccagcaatatccaggcacacgacccccaaatcatctatttangagtcagtactcggccctggtaggtttccatccgcttctcgtgctcaagtctggaccaacgaccggtccctcccgtacgaccctactccgttcgtcgggtcctacccgngggtctacgggaacgggacgacggtcttaggtaatttacttacgtcgactaagtccctagtaatttcgactaatcgtagtcgtaggtctttagtcggttacgttacggggacgtacgggaacctaggtctacgtcgttacgtagccgacgcccgaaaccgg

SEQ ID NO: 321970 - DNA, 538 bp, Homo sapiens
  misc_feature: GZ8MTXP02JDMHS.39.80.H03.1.454.CMB.2.raw
  modified_base (226)..(226): a, c, t, g, unknown or other
  misc_feature (226)..(226): n is a, c, g, or t
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
tcagtcgcactagtcacgaccggtgctcgatttagctgtgcgtcgaagggaaaggggggtctcaggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatctcctgcactggaaccngcagtgacattggtagtgataactatgtctcctggtaccaacaatacccagggaacgccccaaatcatcatttangaggtcaataatcggccctgagggatttcngactcgcttctctgctccaagtctggcaacgacgcctccctgaccatcctctggctccgaggataggaggacgagctagtattattactgtacttactactagtttcgaaaggacgcacgcctaccccgtcgtcggttcgtcgggacggacgggaccaacgggtcgaaccgttcgtacggtcacgtcccgaacggcctcgtcccccg

SEQ ID NO: 321971 - DNA, 572 bp, Homo sapiens
  misc_feature: GZ8MTXP02H42S6.39.80.H03.1.454.CMB.2.raw
  modified_base (220)..(220): a, c, t, g, unknown or other
  misc_feature (220)..(220): n is a, c, g, or t
  modified_base (302)..(302): a, c, t, g, unknown or other
  misc_feature (302)..(302): n is a, c, g, or t
  modified_base (434)..(434): a, c, t, g, unknown or other
  misc_feature (434)..(434): n is a, c, g, or t
tcagtcgcactagtcacgaccggtgctcgatttagctgtgcgtcgaagggaaaggggggtctcaggaggcagcgctctcaggacatctccaccatggcctggactctgctgctcctcaccctcctcactcagggcacagggtcctgggcccagtctggcctgactcagcctgcctcgtgtctggtctcctgacagtcatcacatctctgcactggaaccngcagtgacagttggtagtgataactatgtctcctggtaaccaacaataccccgagggaaccgccccaaaactcatcatttangagtcaaatactcgcctcgaaggtatttctgatcgtcttctctggctccaagtctggacctaaacgccgcctcccagtacccatcctcgtgggcttccgagatggacggacgaaggctaggatttacgtatnacctattacgtaagtttcgaaaggcacctaacgcctaacccccgttgtacgggtttccttacggacgggtacggaaaccgtaacggtcggtaacccgttcgtacgtacgacgacccgacggtccttacccgtcccccg

SEQ ID NO: 321972 - DNA, 668 bp, Homo sapiens
  misc_feature: GZ8MTXP02F50IB.39.80.H03.1.454.CMB.2.raw
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
tcagtcgcactagtcacgaccggtgctcgatttagctgtgcgtcgaagggaaagggggggtctcaggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatcctcctgcactggaaaccngcagtnactagttggtagtgaataactatcgtcctccgtacgtaaccaaacaactaacccgaacgggaacccgacccccaaactcactactattataggtacgtacaaatacgtccggtccctagaggtatttcgtagtactccgtcttctcgtcgtctcctaagtcgtcggacctaaccgacccggtccctcccgtacgacctactccgtcgtcgggtaccctaccgaggtacgtacgggacgggacgagtacgttagtaatttacttacgtcgtacttactacgttaacgtttacggaacggtacgacgtacgtccctacccgttcggttcggttccggttacggggacgggacgggtaaccgtaacggggtccggttacccggttcggttaccgggtaccgtaccggtacccgtacggtcccgtaccggtcccccg

SEQ ID NO: 321973 - DNA, 537 bp, Homo sapiens
  misc_feature: GZ8MTXP02GL3SH.39.80.H03.1.454.CMB.2.raw
  modified_base (299)..(299): a, c, t, g, unknown or other
  misc_feature (299)..(299): n is a, c, g, or t
  modified_base (331)..(331): a, c, t, g, unknown or other
  misc_feature (331)..(331): n is a, c, g, or t
  modified_base (467)..(467): a, c, t, g, unknown or other
  misc_feature (467)..(467): n is a, c, g, or t
tcagtcgcactagtcacgaccggtgctcgatttagctgtgcgtcgaagggaaagggggggtctcaggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatctcctgcactggaaccagcagtgacattggagtgataactatgtctctggtaccaacaatacccaggaacgccccaaatcatcatttangagtacaaataatcggcctacgaggtatttcngatcgcttctctggctcaagtctggacaaccgacggccctccctagacccatcctcgtcggcctaccgaggataggaggacgaggactaggaattattactgtactactctatttacgaagagcacgccacccctntcggtctcgggcggaacgggaccaaggtcgtaaccgtcgttggacacggcccaacggccgtacgcccccg

SEQ ID NO: 321974 - DNA, 528 bp, Homo sapiens
  misc_feature: GZ8MTXP02I7N9G.39.80.H03.1.454.CMB.2.raw
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (439)..(439): a, c, t, g, unknown or other
  misc_feature (439)..(439): n is a, c, g, or t
tcagtcgcactagtcacgaccggtgctcgatttagctgtgcgtcgaagggaaagggggggtctcaggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatctcctgcactggaaccagcagtgacattggtagtgataactatgtctcctggtaccaacaatacccaggaacgcccccaaatcatcattatgagtcaatancggccctnaggtatttcngatcgtcttctctggctccaagtctggccaacacggcctccctgaccatctctgggctcgaggatgagacgaggctagatttattactgcttactctatttcgaaggtanctagccctaccccgtctcggtccttcgggacggacggggaccaagggtcgaccgtcgttcggtacgacgaccgacggcctcgtcccccg

SEQ ID NO: 321975 - DNA, 592 bp, Homo sapiens
  misc_feature: GZ8MTXP02JUMOJ.39.80.H03.1.454.CMB.2.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
tcagtcgcactagtcacgaccggtgctcgatttagctgtgcgtcgaagggaaagggggggtctcaggaggcagcgctctcaggacatctccaccatggcctgggctctgctgctcctcaccctcctcactcaggacacagggtcctgggcccagtctggcctgacacagcctgcctccgtgtctgacgactcctggacagtcgatcaccatctcctgcactggaaccngcagtgacgttggntcttatattntgtctctgtcangctntcagcagccgacccaaatcttaattntgtagttctttcgcgtccttggtacgggtttcacgtctcttcgccgtctacgagtcgtcggacaaccgaccgtccctccgtacgaccctacttcctactacgacctcgacggtctacggacggacgtgtacgtacgtaacttagtttaactcggactagtcctatatactacgtagtaacgttactaagttcgtactaccgtagttcggtcgttacgggttaccgggacgggtacgggtaacctaacggttccggtacccgttacgtacggtaccaaccggtacccgtaacggtcccg

SEQ ID NO: 321976 - DNA, 693 bp, Homo sapiens
  misc_feature: GZ8MTXP02HB1JT.39.80.H03.1.454.CMB.2.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
tcagtcgcactagtcacgaccggtgctcgatttagctgtgcgtcgaagggaaagggggggtctcaggaggcagcgctctcaggacatctccaccatggcctggactctgctgctcctcaccctcctcactcagggcacagggtcctgggcccagtctggcctgactcagcctgcctccgtgtctgggtctcctggacngtcgatcaccatctctgcactggaaccngcagtgactagttggtagtgataactatgtctcctggtaaccaacaactaccccgaagggaacccgacccccaaaactcactactaacttttagaggtaacggtactaaaagttaaaccgtccgggtaccccctagtaaggggtacttttcgtagtacgttcgtctttacgtcgttcggaccttccgtaaagtcgttacggaccaacccgccggtacccctccctacgaccctacttcctccggtcgggtaccctaccgagggtatacgggacgggacgtacgggcttacggtaatttaacgttacgtcgttaccttaaaccgttcttaacgtttaacggaacgggactacctaacgcccctacccccgttggttccgggtcgttaccggggaggaaccggtaccgtaacggtcgtacccgttcgttacgaccgtaccggaccgaacggtcctacccggttcccccg

SEQ ID NO: 321977 - DNA, 588 bp, Homo sapiens
  misc_feature: GZ8MTXP02HMNVJ.39.80.H03.1.454.CMB.2.raw
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
tcagtcgcactagtcacgaccggtgctcgatttagctgtgcgtcgaagggaaagggggggtctcaggaggcagcgctctcaggacatctccaccatggcctggactctgctgctcctcaccctcctcactcaggcacagggtcctgggcccagtcctggcctgactcagcctgcctccgtgtctggtctcctggacagtcatcaccatctcctgcactggaaccagcagtgacagttggtagtgataactatcgtctcctgtaccaacactaccccgaggaaccgccccaaatcatcatttangagtacaatactcgacctnaggtactttcngactcgtcttctgtcggctcgaagtctggacctaaccgacggcccttcccgcgtaccctaattccgtacgtcgggtcccttacccgaggtagtacgggaacgggacgacgtacgttacgtaagtttacgtttactacgtcttaactcgtagtttacggaagcgacgtacgcctacccgtctcgggttctacgggcggtaacggacgacggtaacgtccgtcgttacgccgtacgcccgagtcccgtcgtcccccg

SEQ ID NO: 321978 - DNA, 713 bp, Homo sapiens
  misc_feature: GZ8MTXP02GMA2P.39.80.H03.1.454.CMB.2.raw
  modified_base (227)..(227): a, c, t, g, unknown or other
  misc_feature (227)..(227): n is a, c, g, or t
tcagtcgcactagtcacgaccggtgctcgatttagctgtgcgtcgaagggaaaggggggggtctcaggaggcagcgctctcaggacatctccaccatggcctggactctgctgctcctcaccctcctcactcagggcacagggtcctgggcccagtctggcctgactcagcctgcctcgtgtcgtggtctcctggacagtcgatcaccatctcctgcactggaaccngcagtgactagttggtagtagaataactagtgtactccgtaggtaacccaaactaactaacccgaagggtaaacccggacccccaaaactcaacttacctaattttagaggtacggttaactaaaagttaaacgtcccggacccctagtaaggggtacttttcgtacgtacttccgtctttaccgtcgttcgactacccgtaaagttcgacgggaccaaccgaccggtcccttcccgtacgacctactccgtcggtcggccttacgagtacgtgaacgggtacgtacggtacgttagtaagtttacgttacgtacggtacctttacaacccgtttagttaacggaacggacgaccgtaaccggaccctaccccgttcggtttaccgggttcggttaccggggacgggtaaacggacccgtaaagggtccctaccggttaaccgttacgacgaccgtacccgaacggtcccgtacccggttccccgg

SEQ ID NO: 321979 - DNA, 492 bp, Homo sapiens
  misc_feature: GZ8MTXP01BZCRT.52.77.G11.1.454.CMB.2.raw
  modified_base (316)..(316): a, c, t, g, unknown or other
  misc_feature (316)..(316): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
  modified_base (481)..(481): a, c, t, g, unknown or other
  misc_feature (481)..(481): n is a, c, g, or t
  modified_base (483)..(484): a, c, t, g, unknown or other
  misc_feature (483)..(484): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcagtcaggacattagcaactattaaattggtatcagctacgaaacccgggaaagcccctaaagctcctgatcctgatgcattcactttggaaacngggtccatcaaggttcagtgggaagtggctcgtgggactagtattttactcacatcagcagcctgcagcctgagntatgacanatattangtacaacagtacataatcctacccgctcaacgtttcgggcgggggtaccaaggtggagagttcaaacgaactggngnngctcngtn

SEQ ID NO: 321980 - DNA, 554 bp, Homo sapiens
  misc_feature: GZ8MTXP01DN5K2.52.77.G11.1.454.CMB.2.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
  modified_base (436)..(436): a, c, t, g, unknown or other
  misc_feature (436)..(436): n is a, c, g, or t
  modified_base (477)..(477): a, c, t, g, unknown or other
  misc_feature (477)..(477): n is a, c, g, or t
  modified_base (510)..(510): a, c, t, g, unknown or other
  misc_feature (510)..(510): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtagganacagacgtcaccatcacttgccaggcagtcaggacattagactaaacttaattaaatggtaatcagacctaggaaacccggaatcccctaagctcngactcctgatgctattcgagtttacggaaacgtcgggtacccaagtccgtaaagggttcgaaggtgggaagttcggcgtcgtaggggactagttacttttactcactatcagcagcctgacagctagagtatattgacaatnttaattactagtacaacgtagtactaatactcctacccgtntcgtaacggttcgggacgggggtacaggtgaanacgttacgaaacgtaacgtgtaacgctagacctcgttaagttcg

SEQ ID NO: 321981 - DNA, 548 bp, Homo sapiens
  misc_feature: GZ8MTXP01BFWGB.52.77.G11.1.454.CMB.2.raw
  modified_base (197)..(197): a, c, t, g, unknown or other
  misc_feature (197)..(197): n is a, c, g, or t
  modified_base (276)..(276): a, c, t, g, unknown or other
  misc_feature (276)..(276): n is a, c, g, or t
  modified_base (416)..(416): a, c, t, g, unknown or other
  misc_feature (416)..(416): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtagganacagagtcaccatcacttgccaggcgagtcaggacattagactaactattaaattggtatcagctacgaaacccggaancccctaagctcctgactcctcgatcgctattcacgtttaggaaactacggggtacccagtacaaggtttcaggtgggaagttcggcgtcgtaggggacctagtattttacttcaccatcagcagcctgacagctgagatnttgacaatatattacagtacaactagtactaataactcctccgtctcgtaacgttcggggcggggtaaccagggtacgaagttaacgttacgaaacgtaagtggtaacgtcgagaccgtaacttaagttccg

SEQ ID NO: 321982 - DNA, 542 bp, Homo sapiens
  misc_feature: GZ8MTXP01D3JG4.52.77.G11.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (459)..(459): a, c, t, g, unknown or other
  misc_feature (459)..(459): n is a, c, g, or t
  modified_base (537)..(537): a, c, t, g, unknown or other
  misc_feature (537)..(537): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtagganacagagtcaccatcacttgccaggcgagtcaggacattagctaaacttattaaaattggtattcaagcgtaaggaaaccccgggaancccctaaagctcctgactcctcgatgctattcacgtttaggaaacaggggtcccatcgaaggttcaggtgggaagtggctcgtagggactagtatttacttcacctatcagcagcctgcagctagagatattgacatattagttactgtacactagtacgaataactccgtcccncttcgtaacgtttcggggacgggggtacaagggtggaagttacttacgaaacgtaagtggtaagctgactaaccgttnttccg

SEQ ID NO: 321983 - DNA, 580 bp, Homo sapiens
  misc_feature: GZ8MTXP01C0AO7.52.77.G11.1.454.CMB.2.raw
  modified_base (278)..(278): a, c, t, g, unknown or other
  misc_feature (278)..(278): n is a, c, g, or t
  modified_base (435)..(435): a, c, t, g, unknown or other
  misc_feature (435)..(435): n is a, c, g, or t
  modified_base (536)..(536): a, c, t, g, unknown or other
  misc_feature (536)..(536): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtagagacagagtcacatcacttgccaggcagtcaggacattagactaacttattaaattggtatcagtacgtacgaaaccccggaancccctaagcctcctgactcctgatgctatctacgtttaggaaacgtcggggtacccagttacgaaggttcagggtgggacgttaggcgtcgtaggggactagtacttttacttacactatcgagtcacgtcctgacgagtctaggaagtattagttnacctaatacttagtttacacgttacaaacgtaggtactataacgttccacccgtcttacgaacggtttcgggggacgggggtaaccttaggggtacggtanacgttacgaaacgtaacgtggtcggctggacctaaccgttgtcg

SEQ ID NO: 321984 - DNA, 530 bp, Homo sapiens
  misc_feature: GZ8MTXP01DBTV3.52.77.G11.1.454.CMB.2.raw
  modified_base (273)..(273): a, c, t, g, unknown or other
  misc_feature (273)..(273): n is a, c, g, or t
  modified_base (315)..(315): a, c, t, g, unknown or other
  misc_feature (315)..(315): n is a, c, g, or t
  modified_base (443)..(443): a, c, t, g, unknown or other
  misc_feature (443)..(443): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactattaaatggtatcagctagaaaccccggaancccctaaagctcctgactcctgatgctatcactttaggaacnggggtccatcaaggtcagtggaagtggctgtgggactagtatttacttcactatcagcagcctgcagctagagatagttgacaactattacttaactcgtaacaacagtacgaataactcctacccgntaccgtaacgtttcggggacgggggtaaccagggtcggagaacgttcgaaaacgtaacgtggtaacggctgacctaacgaatttccg

SEQ ID NO: 321985 - DNA, 570 bp, Homo sapiens
  misc_feature: GZ8MTXP01AL46V.52.77.G11.1.454.CMB.2.raw
  modified_base (197)..(197): a, c, t, g, unknown or other
  misc_feature (197)..(197): n is a, c, g, or t
  modified_base (272)..(272): a, c, t, g, unknown or other
  misc_feature (272)..(272): n is a, c, g, or t
  modified_base (319)..(319): a, c, t, g, unknown or other
  misc_feature (319)..(319): n is a, c, g, or t
  modified_base (547)..(547): a, c, t, g, unknown or other
  misc_feature (547)..(547): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtagganacagatcaccatcacttgccaggcgagtcaggacattagctaactattaaatggtatcagctagaaacccggaancccctaagctcctgactcctcgatcgctattctacgtttaggaaacnggggtcccagtaccgtaaggttcaggtgggaagtggctcgtagggactagttacttttacgttcacctatcgagcaacggccttaggacacgtccgtagtaggattagttacacaaacgtattaattacttagacctaagtagtaccaataactcctacccgtctcgtaaccgtttcggggccgggggtaacttaggggtagaagttacgttaccgaaacgttaaggngtcggctcgactaaccgttgtcg

SEQ ID NO: 321986 - DNA, 589 bp, Homo sapiens
  misc_feature: GZ8MTXP01DQJGM.52.77.G11.1.454.CMB.2.raw
  modified_base (197)..(197): a, c, t, g, unknown or other
  misc_feature (197)..(197): n is a, c, g, or t
  modified_base (431)..(431): a, c, t, g, unknown or other
  misc_feature (431)..(431): n is a, c, g, or t
  modified_base (455)..(455): a, c, t, g, unknown or other
  misc_feature (455)..(455): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtagganacagagtcaccatctacttcgccgagggcgagtcgaggactattacgactaattaattaaagtggtatacagtacgtaacggaaaaccccgggaactacccctaaagcctacctagactaccctagatcgacttaattcgtaacgtttacggaaacgtcggggtaccctaagtacgtaaaggttcgaaggtgggaagtcgcgtgtagggactagttacttttactcactatcancagcctgacagctagagtatagtnacaagtattattactatacaagtacgtaatactaactccgtccgtcttacgtaacggttcgggggacgggggtacaagggtaggagttaacttacgaaacggtaacgttagcggtcacggactaaccgttgtcg

SEQ ID NO: 321987 - DNA, 581 bp, Homo sapiens
  misc_feature: GZ8MTXP01AZBM5.52.77.G11.1.454.CMB.2.raw
  modified_base (197)..(197): a, c, t, g, unknown or other
  misc_feature (197)..(197): n is a, c, g, or t
  modified_base (277)..(277): a, c, t, g, unknown or other
  misc_feature (277)..(277): n is a, c, g, or t
  modified_base (291)..(291): a, c, t, g, unknown or other
  misc_feature (291)..(291): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtagganacagatcaccatcattgccaggcgagtcaggacattagactaattaattaaatggtatcagcgtacgaaacccgggaacncccctaaagctccngactcccagatgactattcacgtttaggaaactcgggtcccaatccgtaaaggtcgaggtggaagtgctcgtagggacctagttattttacgtcacctatcgagcacgctgacagtctggagattatgacaagtattattactagtacaacgtagtaactacttaactcccgtccctacgttacgttaacggtttccgggggaccgggggtaaacaaggggttacggaacgttaaacgttaccgaaacgggtaacgtggtaacggtctacggacctcttaaggtttcccg

SEQ ID NO: 321988 - DNA, 578 bp, Homo sapiens
  misc_feature: GZ8MTXP01AM016.52.77.G11.1.454.CMB.2.raw
  modified_base (273)..(273): a, c, t, g, unknown or other
  misc_feature (273)..(273): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagctaactattaaatggtatcagctagaaacccggaancccctaagctctgactcctgatgctattctacgtttaggaaactcggggtcccatacgtaggttcgaggtgggtaagtgggctcgtggggactaggttacttttacttcactatcagcagtcctgcagctgagatatgacaactattattactacgtacaaacgtgtaaacgtataactcctaccccgtctcccggtaacggtttccgggggaccgggggtaaccttaagggggttacggaacgttacgttaaccgaaacggtaaccgtggtaacgggtcctcggacctaaccgttaatttcccg

SEQ ID NO: 321989 - DNA, 514 bp, Homo sapiens
  misc_feature: GZ8MTXP01DG759.52.77.G11.1.454.CMB.2.raw
  modified_base (273)..(273): a, c, t, g, unknown or other
  misc_feature (273)..(273): n is a, c, g, or t
  modified_base (316)..(316): a, c, t, g, unknown or other
  misc_feature (316)..(316): n is a, c, g, or t
  modified_base (379)..(379): a, c, t, g, unknown or other
  misc_feature (379)..(379): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
  modified_base (509)..(509): a, c, t, g, unknown or other
  misc_feature (509)..(509): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtaggagacagagtcaccatcacttgccaggcagtcaggacattagcaactattaaattggtatcagctagaaacccggaancccctaaagctcctgatcctcgatgcattcactttaggaaacnggggtacccatcaaaggttcaaggtgggaagtggctctggggaaactagtacgttttactttnacccatcagcagcctagcagctgagatatganacatatatatacaacagtanataatactcctctctaacgttcgggcggggtaccggaggtaggagagacttaacgaacgtagtggcgtcgacaaccgngtaac

SEQ ID NO: 321990 - DNA, 484 bp, Homo sapiens
  misc_feature: GZ8MTXP01DNNGV.52.77.G11.1.454.CMB.2.raw
  modified_base (316)..(316): a, c, t, g, unknown or other
  misc_feature (316)..(316): n is a, c, g, or t
  modified_base (380)..(383): a, c, t, g, unknown or other
  misc_feature (380)..(383): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
  modified_base (416)..(416): a, c, t, g, unknown or other
  misc_feature (416)..(416): n is a, c, g, or t
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
tcagcgcagtacgacacgaccggtgctcgatttagctagtcactcaagggaaaggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactattaaattggtatcagctgaaacccgggaaagcccctaaagctcctgatcctcgatgcaattcactttggaaacnggggtcccaatcaaaggttcagtgggaatggctctgggacagattttacttcacatcagcagcnnnncngagatatanacaacatatatatacaacatanaatactctcctctctcgtcgggcggggacggaggtaggagagacaacgaatagtgcncgctaacnctn

SEQ ID NO: 321991 - DNA, 522 bp, Homo sapiens
  misc_feature: GZ8MTXP01E1ZOY.52.77.G11.1.454.CMB.2.raw
  modified_base (324)..(324): a, c, t, g, unknown or other
  misc_feature (324)..(324): n is a, c, g, or t
  modified_base (361)..(361): a, c, t, g, unknown or other
  misc_feature (361)..(361): n is a, c, g, or t
  modified_base (425)..(425): a, c, t, g, unknown or other
  misc_feature (425)..(425): n is a, c, g, or t
  modified_base (487)..(487): a, c, t, g, unknown or other
  misc_feature (487)..(487): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctcctgtctgcatctgtaggagacagagtcaccatcacttgccaggcagtcaggacattagcaactattaaattggtatcagctacggaaaccccgggaagccccctaagcctcctgactcctcgatgctattcacgtttagggaaaccngggggtcccatcaaggttcaggtgggaagtggctcgngggactagtattttacttcaccatcagcagcctgcagcctgagtatatgacaactatattacgngtacaacagtaaccataactcctcccgctcgaacgttcgggacggggaccgaaggtgggaanattacgaaaccgtaagtgtggcncgactccngtcg

SEQ ID NO: 321992 - DNA, 552 bp, Homo sapiens
  misc_feature: GZ8MTXP01EFXNA.52.77.G11.1.454.CMB.2.raw
  modified_base (277)..(277): a, c, t, g, unknown or other
  misc_feature (277)..(277): n is a, c, g, or t
  modified_base (325)..(325): a, c, t, g, unknown or other
  misc_feature (325)..(325): n is a, c, g, or t
  modified_base (421)..(421): a, c, t, g, unknown or other
  misc_feature (421)..(421): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtaggagacagagtcaccatcacttgccaggcagtcaggacattagctaaactattaaatggtatcaagctagaaaccccgggaancccctaaagctcctgactcctacgatgactattcacgtttaggaaacncggggtcccatccgaaaggttcaggttgggaagtggcgtcgtagggactagttacttttactcacctatcagcagcctgcagtctagagatattanactaagtattattactataactaacgtagtactaactactcctcctcgtcgtaacgggttcggggacggggtacgaagggtaggaagttaacgaacgaaacgtaacgtggtcgctcgactaaccgttgtcg

SEQ ID NO: 321993 - DNA, 581 bp, Homo sapiens
  misc_feature: GZ8MTXP01APOYX.52.77.G11.1.454.CMB.2.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (288)..(289): a, c, t, g, unknown or other
  misc_feature (288)..(289): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (342)..(342): a, c, t, g, unknown or other
  misc_feature (342)..(342): n is a, c, g, or t
  modified_base (509)..(509): a, c, t, g, unknown or other
  misc_feature (509)..(509): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcgtggtttcgtcgttaggctctttaagaggtgtcagtgtcaggtgcagctggtggagtcgtgggggagcgtggtccaggcctggggacggtccctgagactctcctgtgcagccctntggattcaccttngtntntannacntgcncgtcggccncgcggcctacgaggacggagggtcgtgggaggttggnggactaggttatatctagtagtaagtagtaaggtaaagtaaagtaatatatatagacgacgtacgtacggtacggacggacgtactactactactacacgacgaacaactaacaacgaacgacgtacgtagttagttagtactaagagaacgtacgacgagagaagngaggacggacgtacgtcgttgttgttagttaagtagtaacgtacgtaacgttaacgtaacggaacggaacgg

SEQ ID NO: 321994 - DNA, 658 bp, Homo sapiens
  misc_feature: GZ8MTXP01D6R7Q.52.77.G11.1.454.CMB.2.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtagganacagagtcaccatcacttgccaggcgagtcaaggacattagactaacttaattaaattggtaattagacgtacggaaacccggaaacncccctaagcctacctgactcctacgatcgactatttacacgtttaggaaacgtacggggtacccaagttaccgtaaaggttcgaagggtggggtaggttcgggtaccgttcgggtaggggtaactaggtttaactttttacctttacacctattccaggtccacgccgtcgacacgtcctaggaaggtactattacgaactaaactagtttaacttaacgtacgttaacaaacgtacgtaactaacttaaactccctcccgtactccgttaaccggttcggggaaccgggggacgtaagggttcggaaagtacgttaacggaaacgttaacgttggacggtaacgttccgacgttaacctcttcggtttccg

SEQ ID NO: 321995 - DNA, 642 bp, Homo sapiens
  misc_feature: GZ8MTXP01ALQMW.52.77.G11.1.454.CMB.2.raw
  modified_base (284)..(284): a, c, t, g, unknown or other
  misc_feature (284)..(284): n is a, c, g, or t
  modified_base (332)..(332): a, c, t, g, unknown or other
  misc_feature (332)..(332): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagactaacttattaaattggtatcgagacgtaacggaaaccccgggaancccctaaagcctacctgactcctcgatgctattcacgtttaggaaacngggtcccatcgaaaggttcaggtgggaagtcggcgtcgtgggactagttacttttacttcactatcaagcacgcctgacacgtcctaggagtaattagttacgactaaacgtattactttaacgtagttaaccaaacgtacgttaacgtaacttaaaccttcccgtacccgtcccgtacggttaacccgggttttccggggggacggggggtaaacccgttaaggggttaacgggaacggttacgttaacccgaaaaccgggtaagttcgggtaacggttccgtacggacccttaaccgttaactttccg

SEQ ID NO: 321996 - DNA, 674 bp, Homo sapiens
  misc_feature: GZ8MTXP01A6F0V.52.77.G11.1.454.CMB.2.raw
  modified_base (199)..(199): a, c, t, g, unknown or other
  misc_feature (199)..(199): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtcctgcatctgtagganacagagtccacatcacttgccgaggcgagtcaaggactattagactaaacttaattaaatggtatcagcgtaacggaaaccccggaagacccctaaagcctccgtagactccgtgatcgactattcgactttaggaaacgcggggtacccagtacgtaaggttcgaaggtggggtaacgtgggctcggtagggaactagttattttaccttacacctattcgaagtccgacgtccctagaccgtacgtccgtaggtaggtattaccgttagaactaaaccgtagttaaatttaccgtacgttaactaaacccgtaggtaaacgttaactaaaccttcccgttccccgtacttacccggtaaccgggttttaccgggggaacccggggggttaccaaagggggtccggttaaagacgttaaaccgttaaacggtaaccgttgggtcggctacggacccgtaacgttaactttccgg

SEQ ID NO: 321997 - DNA, 664 bp, Homo sapiens
  misc_feature: GZ8MTXP01DZPBV.52.77.G11.1.454.CMB.2.raw
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggactatagacaacttattaaattggtatcagacgtacggaaacccggaagcccctaagctcctgactcctcgatcgctattcgtacgtttacggaaacgtcggggtacctacgtacgtaaggttcgaggtgggaagtggtcgtcgtaggggactagttacttttacttacacctatacacgtcacgccctagaccgtagtccgtaggaggtaattagttagaacctaaacgttatttaacgttaccttacggtaactaaaccgtagttaaaccgtaaactttaacctcccgtttaccccgtccgttacccgttaaccggggttttccggggggaccggggggtaaacccgttaaagggggttaacgggaacggttaaccgttaccgaaaacggtaaccgtaggtaacgggtctacggactaacgttaaccttaag

SEQ ID NO: 321998 - DNA, 686 bp, Homo sapiens
  misc_feature: GZ8MTXP01EBFQQ.52.77.G11.1.454.CMB.2.raw
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtaggagacagagtcacatcacttgaccaggcgagtcaggactattacgactaaacttattaaagtggtaatcgagacgtaacggaaaccccggaaacacccctaaagcctactgactccgtgactgacttattcgtacgtttacggaaacgtcggggtaccaagtacgtaaggttcgagggtgggtaagtggtcgtaggtagggtaactagtttactttttaccttcaaccctattacgaacgtcgtaacgccgttagacccgaaggtccgtaggtaaggtaattacttagaacccttaaagtaactttaagtttaaccctagttaaccaaaacgtacgttaaacgtaaactaaacgttcccctacccggtcttaacccgggttaacggtttaccggggggaccgggggtaaaccttaagggggacgtaaacgggttaacttacccggaaaagtcggtcggtaacggtccgtacgacctaacccgtttcgtccg

SEQ ID NO: 321999 - DNA, 594 bp, Homo sapiens
  misc_feature: GZ8MTXP01DZ3X0.52.77.G11.1.454.CMB.2.raw
  modified_base (196)..(196): a, c, t, g, unknown or other
  misc_feature (196)..(196): n is a, c, g, or t
  modified_base (272)..(272): a, c, t, g, unknown or other
  misc_feature (272)..(272): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctcctgtctgcatctgtagganacagagtcaccatcattgccaggcagtcagacattagacaactattaaatggtatcagctacggaaacccggaacncccctaaagctcctgactcctacgatgctattctacgtttaggaaactcggggtacccaagtaccgtaaaggttcgaggtcgggtaagtcggcgtcgtagggactagtactttacttcactatcagcagctgcagcgtagagtatattacgactaagtaattacgttaactacgtaacaaaccgtagtaacgtaacttaaactcctcccgtacttcgtaacgggtttcggggacgggggtaaccaagggtacggaacgttacggttaacgaaaacggtccgttaaggtcgggtcctacgggacctaaccgttaactttcccg

SEQ ID NO: 322000 - DNA, 701 bp, Homo sapiens
  misc_feature: GZ8MTXP01EVPEF.52.77.G11.1.454.CMB.2.raw
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccagcctgggagtccctgagactctcctgtgcagcctctggattcaccttcagtgtctatgacatgcacgtgggtccgcaggctccgaggccaagggggctgggagtggggtgctagttatatcaatagtagaatgggaaattaaagacttaataactagtacgactagtaccgttccggtagggaacgggggtcccgtaatttacccgaacccttaacttttaccccgaaggtaacgaaaccctaaaaccttaaccccgaaaaacgggggaaacctaaccgggttaccttacggtttaatttacggaaacctaaaagttacggaaaacacggtacccgttaggaacggaaggtaccgttacgggaaagggttaccgaaccgggtcgtttagggtttacttaagttttaaccggtacgttaaggttaaccggtaaactttaaacgttaaccggttaaccggggtaaaccgggg

SEQ ID NO: 322001 - DNA, 655 bp, Homo sapiens
  misc_feature: GZ8MTXP01BU72P.52.77.G11.1.454.CMB.2.raw
  modified_base (201)..(201): a, c, t, g, unknown or other
  misc_feature (201)..(201): n is a, c, g, or t
tcagcgcagtacgacacgaccggtgctcgatttagctagtcactcaagggaaagggggagtcagtcccaaccaggacacagcatggacatgagggtccctgctcagctccgtggggctcctgctgctctggctctcaggtgccagatgtgtcatccagatcgacccagtcctccatccctccctgtctgcatctgtagganacagatcacatcactgccgaggcgagtcaaggactattagactaacttaattaaatggtatcagacgtaacggaaaccccggaactcccctaagcctctgactcctagatcgactattcgtacgttaggaaacgtcgggtaccagttacgaaggttcgaggtggaagtggctggtagggtactagtttacttttactacacctatcacgtcgacgtcctgaccgagtccgtaggacgtatacgttacaacttaacgtatttaattacgtacgttaaacaaaccgtagttaacgtaacttaacctccccgttcccgtacttcccgggtaaccggggtttccggggggaaccgggggtaaaccgttaaaggggttacgggaacggttaaccgttaaacggaaacggttaaccgggtggtaacgggtacctcggaaccctaaccggttaacttccgg

SEQ ID NO: 322002 - DNA, 603 bp, Homo sapiens
  misc_feature: GZ8MTXP01CDC5H.52.77.G11.1.454.CMB.2.raw
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
  modified_base (328)..(328): a, c, t, g, unknown or other
  misc_feature (328)..(328): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcacatggagtttggctgagcttgggttttcctcgttgcttcttttaagaggtgtccagtgtcgaggtgcagctggtggagtcgtgggggagcgtgtccagccgtgggagtcctgagactctctgtgcagcctntggacttcaccttnagtgtactatgacatgcacgtgggtcccncgacggctacgaggacgaggggntggaggtggtgactagttatatgtatagtaagaagtaaggaaataagataactatagcgacacgtacgtacggacggaacggtaccgtattacctaacttacttacgaagacgaaccaactaacgaaacgaactacgtacgttagttaacgttacgaactaaacgtaacgaacgtacgtacgtacgagtaagacgttacggacggacgtacggtacgttagttgttacgttaacgttagtaacgtacgtaacgttaacgtaacgaacggtaacgg

SEQ ID NO: 322003 - DNA, 696 bp, Homo sapiens
  misc_feature: GZ8MTXP01C72AQ.52.77.G11.1.454.CMB.2.raw
  modified_base (489)..(489): a, c, t, g, unknown or other
  misc_feature (489)..(489): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgacccagtcctccatccctccctgtctgcatctgtaggagacagagtccaccatcacttgccgaggcgagtcaaggactattagactaaacttaattaaagtggtatcgagtaccgtaacggaaaaccccggaactccccctaaagccttacctggacccttcccgtacgagttcggacctttaacttccgttaaacgtttacggaaaaccggtcggggtaccctaagtacggtaaaggttcgaagggtgggtaacgtgtcgtcggtacgggtaacttacgttacttttacttacactatcaggtcacgctgactacgtctaggaagtnttaacgtacgaacctaaagttacttaacgtttaactacgaactaaaccgtaaggttacgttaaaacttccgttcccgtaccccggtcgtttaacccgggtaaccggggtttcggggggaaaccgggggtaaacgaaggggttaccggaaagttaacgttaaacgaaaaccggttgtcggtcggtaactcggacctaacttgtttccg

SEQ ID NO: 322004 - DNA, 619 bp, Homo sapiens
  misc_feature: GZ8MTXP01EI2IQ.52.77.G11.1.454.CMB.2.raw
  modified_base (274)..(274): a, c, t, g, unknown or other
  misc_feature (274)..(274): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
tcagcgcagtacgacacgaccggtgctcgatttagctagtcactcaagggaaaggggagtcagtcccaaccaggacacagcatggacatgagggtccctgctcagctcctggggctcctgctgctctggctctcaggtgccagatgtgtcatccagatgacccagtctccatccctccctgtctgcatctgtaggagacagagtcaccatcacttgccaggcagtcaggacattagcaactattaaatggtaatcagctgaaacccgggaaacncccaagctctnactcctnatgctattctacgtttaggaaacgtcgggtaccatacgtaaaggttcgaggtgggaagtgggctggtagggactagttattttactcacctatcagcagcctgacacgtcgtagaaggtatagtacgacaacgtaattaacttaacgttacgtactaacgtaacgtaacgtaacgtaaacttaccgtacccgtaccgtaccgttaaccggtttaccggggttaccgggggtaaccgggttaaacgggtaacgggtaacggttaacgttaaccgttaaaacgtaacgtacggtaacggtcgtacgttaccgtaaccgttaacgtaacg

SEQ ID NO: 322005 - DNA, 548 bp, Homo sapiens
  misc_feature: GZ8MTXP01A0GK2.52.77.G11.1.454.CMB.2.raw
  modified_base (304)..(304): a, c, t, g, unknown or other
  misc_feature (304)..(304): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcacccatggagtttgggctgagctgggttttcctcgttgctcttttaagaggtgtccagtgtcaggtgcagctggtggagtcgtgggggaggcgtggtccagcctgggagtccctgagactctcctgtgcagcctctggattcaccttcagtgtctatgacatgcacgtggtccncaggctccgaggcaagggggctgggagtggggtggctaggttatagtcatatgaatgggaaagtaagatatactatgacagactcgtagaggcgattcgactattccagacgacaactacaagaacacgtactagtattgactaaagtgaacagcctagaacgaagcgttaggacggacgaacgggtcttggttcgttagttaacttgggtcgacgtaacgttaacgtccgaacgggtaacggg

SEQ ID NO: 322006 - DNA, 557 bp, Homo sapiens
  misc_feature: GZ8MTXP01D3S0J.52.77.G11.1.454.CMB.2.raw
  modified_base (197)..(197): a, c, t, g, unknown or other
  misc_feature (197)..(197): n is a, c, g, or t
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
  modified_base (493)..(493): a, c, t, g, unknown or other
  misc_feature (493)..(493): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgctcttttaagaggtgtccagtgtcaggtncagctggtggagtcgtgggggaggcgtggtccagcctgggagtccctgagctctctgtgcngcctctggattcacttcagtgtctatgacatgcacgtggtccnccaggctccgaggcaagggggctgggagtggggtgactagttatatcatatgattgggaaataaagacttaatacgtaatggacagacgtaccgtaggaacgggcctattaccgacctatttacccaaggacaacaaactccaaaggaaacacggtactagttatttcgataaatagaacagcctgagaagngttagaggacgacggtcgttagttgttataacgttgtcgaccgtaattactcgaacgggaacgg

SEQ ID NO: 322007 - DNA, 595 bp, Homo sapiens
  misc_feature: GZ8MTXP01ELPL9.52.77.G11.1.454.CMB.2.raw
  modified_base (295)..(295): a, c, t, g, unknown or other
  misc_feature (295)..(295): n is a, c, g, or t
  modified_base (421)..(421): a, c, t, g, unknown or other
  misc_feature (421)..(421): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgacccagtcctccatccctcctgtctgcatctgtaggagacagagtcaccatctacttgccaggcgagtcaaggactagttaagactaaattattaaaagttggtaatcaagtacgtacggaaaaccccgggaancccctaaagctacctgactcctgactgacctattcacgtttaggaaacgtcgggtaccatacgaaggttcaggtgggagttcgcgtgagggactagtacttttactcacatcagctagcctgaccntacgtagagtatatacgacctaaagtatttaacttactacgtaacaaacgtaacgtaacgtaactaacgtcctccggtactcgtaacgggttcgggggacgggggtaaccttaggggtacgaagttacgttaacgaaaccgtaagtacgtcggactcgactaaccgttgttccg

SEQ ID NO: 322008 - DNA, 631 bp, Homo sapiens
  misc_feature: GZ8MTXP01ATJ2Z.52.77.G11.1.454.CMB.2.raw
  modified_base (439)..(439): a, c, t, g, unknown or other
  misc_feature (439)..(439): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagatcaccatcacttgccaggcgagtcaggacattagactaacttattaaatggtatcagcgtaggaaaccccggaagcccctaaagctacctgactcctcgatcgctacttcacgtttagaaacgtaggggtccccaagtacgaaggttcgagggtgggaagtcgggctcgtaggggactagttactttttaccttacaccctatacgagcagccctagcagcctagaggattagttanacctaaagtaattacttacgtacgtacaaaccgtaggttaacgaactttaaacgtccccttacccggtccttacccggtaaccgggtttccgggggaaccgggggtaaccgttaaagggggacgtaagaacgttaaccaaaacgggtaaccgtacgggttgggaccctggacccgtaaccttcggtttcccg

SEQ ID NO: 322009 - DNA, 596 bp, Homo sapiens
  misc_feature: GZ8MTXP01CS7O2.52.77.G11.1.454.CMB.2.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (348)..(348): a, c, t, g, unknown or other
  misc_feature (348)..(348): n is a, c, g, or t
  modified_base (424)..(424): a, c, t, g, unknown or other
  misc_feature (424)..(424): n is a, c, g, or t
  modified_base (442)..(442): a, c, t, g, unknown or other
  misc_feature (442)..(442): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgacccagtcctccatcctccctgtctgctatctagtagganacagacgtacacatcacttgccaggcgagtcaggactattaagctaaattattaaatggtatcgagactacggaaaccccggaancccctaagctctagactccagntnctatcagttacgaaacgtcggtccaagtcgtaaggttnagggtgggaacgtgcgtcgtagggctagttctttacctcactatcagtccagcctgacacgtcgtgagtatcgtanactaatattaaccgttanacgtaacaacgtacgtaacgtaacttactcccgttacccgagtttaccccgtaacgggtttaaccgggggacgggggtaaaccttagggtaacgggacttaacgttaccgaaacgtccgtaggtcggtactacggacctaacttaaccgtttcg

SEQ ID NO: 322010 - DNA, 641 bp, Homo sapiens
  misc_feature: GZ8MTXP01EK0CT.52.77.G11.1.454.CMB.2.raw
  modified_base (269)..(269): a, c, t, g, unknown or other
  misc_feature (269)..(269): n is a, c, g, or t
  modified_base (562)..(562): a, c, t, g, unknown or other
  misc_feature (562)..(562): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgctctttttaagaggtgtccagtgtcaggtgcagctggtggagtcgtgggggaggcgtggtccagccgtgggaggtccctgacgactctcctgtgcagcctntggattcaccttcagtgtctatgacatgccacgtcgggtccgccgaggcctaccgagggaccgaaggggggctaggggaggtggggtgctaggtttatatcgaattagtagaattaaggggaaagtaaagtaattattactagtgacaagtaccgtaccggtagggaacgggtccgtaactttaccaaccttaactttacccgaaagaacgaacctaaacgtacccaaaacgggaaaccgacgtacttaggttatttacgactaaaatacgaactaagtcctaggagtaacgngttagacggacgacggtgttaggttgttaacgttcgtgtaacgtacgtaacttaacgtaaccggttaacgggaaccggg

SEQ ID NO: 322011 - DNA, 597 bp, Homo sapiens
  misc_feature: GZ8MTXP01B8LCG.52.77.G11.1.454.CMB.2.raw
  modified_base (313)..(313): a, c, t, g, unknown or other
  misc_feature (313)..(313): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttggggttttcctcgttgcttcttttaagaggtgtccagtgtcaggtgcagctggtggagtcgtgggggaggcgtggtccagccgtggggacgtccctgacgactctctgtgcagcctctggacttcaccttcagttgtctatgacatgcacgtcgggtccncaggctccgaggcgaaggggctggagtgggnggctagttatntcgatatagatgggaaataagactagtactatgacgagtacgtccggtaggaacgggccgtaacgttaccaaccttaacgtttacccaagacgaacaaacgtaccaaacggaacacgtctagtatttagactaaagtagaactagacctaggagtaagcgttagggacggacgtaacggcttaggttgttactttaacgtgtaacgtacgtaaacgttacgtaaccggaacggggtaaccgg

SEQ ID NO: 322012 - DNA, 683 bp, Homo sapiens
  misc_feature: GZ8MTXP01EGFJX.52.77.G11.1.454.CMB.2.raw
  modified_base (198)..(198): a, c, t, g, unknown or other
  misc_feature (198)..(198): n is a, c, g, or t
  modified_base (630)..(630): a, c, t, g, unknown or other
  misc_feature (630)..(630): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatcgtgagganacagactccactatctacgtcgaccgaggcgtagtacgaggactattaagactaaatttaattaaagtggtatcgaagtaccggtaaaccggaaaaccccgggaactcccctaaagtcctacctaggtacctcccgtagattacgacctttaattaccgtaacgtttacggaaacgcgggtacccaagttacgtaaggttcgagggtcgggtaagtggtcctgggtagggtactaagtttacttttaccgtacaacctatcaacgcgacgtcctagaccgtacggtactagggaaagtacttaagttagaaccccttaaagttaagtttaacgttaacctcggtaaacaaacccgtagttaacgtaactaccgtccccgtcccgtctttaccgggtaacccggttggggggaacccggggaacttaaagggngtaacttacgttaaacgaaggtaactgggaacgtcacgacctaaccgttgtcg

SEQ ID NO: 322013 - DNA, 531 bp, Homo sapiens
  misc_feature: GZ8MTXP01CP8Z9.52.77.G11.1.454.CMB.2.raw
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (303)..(303): a, c, t, g, unknown or other
  misc_feature (303)..(303): n is a, c, g, or t
  modified_base (349)..(349): a, c, t, g, unknown or other
  misc_feature (349)..(349): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtncagcctntggattcaccttcagtgtctatgacatgcacgtgggtcccnccgaggcctccgaggcgaagggggctgggagtggggtgctagttanatcatatgatggaaagtaagatatactatgacagactcggtagacggcctagtcacctattccagtacgacaactaccaagaacacgctacgtattgacaaatcgaacagcctagagaagcttggaggacgacggtcttgttgttattaacgtgtcgacgtaacttactcgaacgggaacgg

SEQ ID NO: 322014 - DNA, 589 bp, Homo sapiens
  misc_feature: GZ8MTXP01CMWA1.52.77.G11.1.454.CMB.2.raw
  modified_base (197)..(197): a, c, t, g, unknown or other
  misc_feature (197)..(197): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtagganacagatcaccatcacttgccaggcagtcaggacattagactaacttattaaattggtatacagactacggaaaccccgggaacgacccctaagctcctgactcctcgatcgctattctacgtttacggaaacgtcggggtacccaagtacgtaaggttcgaggtgggaagttcggcgtcgtagggtactagttacttttacttcactatcagcagcctgacacgtcctgagatatagactaacgtattaattactacgtaacaacgtagtactaacttaactccctccgtaccttcgtaaccgggttcggggaccgggggtaacaaggggtacggtaacgttacgttaacgaaacggtaacgtggtcgtacgtcgacctaaccttcgttccg

SEQ ID NO: 322015 - DNA, 703 bp, Homo sapiens
  misc_feature: GZ8MTXP01B2YMN.52.77.G11.1.454.CMB.2.raw
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtaggagacagagtcaccatcacttgccaggcgagtcgaggactattagactaaacttaattaaagtggtatcagaccgtaacggaaaaccccgggaacacccctaaagcctacctagacctcctacgatacgctactttcgtaacgtttacgggaaacgtcggggtaccctagtaccggtaaggttcgagggtggggtaagtgggtcgtacggtagggtacttaagtttactttttacctacacctatcgaacgcgtaacgtccctaggacctaacggtccttaagggaaggttaactttaggttacgaacccttaaagttaacgtttaaacgtttaccttaggtaaaccctaaagtacggttaaacgtaaactttaaccgtcccttaccccgtacgttaccggttaacggggtttcccgggggacgggggtaacccgaaaggggtacggaacgacgttaaccggaaacggtaacggttgggtcgtaccgtacgacctaaccgttgttccg

SEQ ID NO: 322016 - DNA, 598 bp, Homo sapiens
  misc_feature: GZ8MTXP01D1OCJ.52.77.G11.1.454.CMB.2.raw
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtctgggggagcgtggtccagcctgggagtccctgagactctcctgtgcagcctctggattcaccttcagtgtctatgacatgcactgggtccncccaggctccgaggcaaggggctggagtggtgcagttanatcatatnatggaaataagntatactatgacagactaccgtagagggtacgacttactacctaacttacctacgagaacaaactaccaaacggggaaacgaacgtaccgtacgttattaggtaccgtaaacgtaaacgaaacgtaacgtaccgtacgaagaacgtacgttacggaacggaacggtaacggtacgttacgttagttacgttaacgttagtaacgtacgtaacgttaacgtaaccgaacgggtaacggg

SEQ ID NO: 322017 - DNA, 663 bp, Homo sapiens
  misc_feature: GZ8MTXP01EO7G7.52.77.G11.1.454.CMB.2.raw
  modified_base (202)..(202): a, c, t, g, unknown or other
  misc_feature (202)..(202): n is a, c, g, or t
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgacccagtctccactccctccctgtctgcatcgtagtagganacaggactcacatccattcgccgaggcgagtcgaggactattacgactaaattattaaagtgtancaagcgtaacgaaacccggaacncccgtaanctcctagactcctagatgaccttattacgtaagttacggaaacgacgggtaccaagtaccgtaaggttcaggggtggtaacgtcgggtctaggtacgggtaacttacggttttacttttaacgtcctaaacacgttacaggaccgtaacgtcctacggactaccgtcgtaggtaaagtattacgttaacacctaaagtaatttaccgttaactacgtaaacctaaagtacgttaaactactaacttcccgtaccgtcgtacgttaacggggttccgggggaacgggtaaacgttagggacggtaacttaacggacgttaaaccggtaagttgccgggtatacgaacctaaccgttaatttcccgg

SEQ ID NO: 322018 - DNA, 728 bp, Homo sapiens
  misc_feature: GZ8MTXP01EJIQJ.52.77.G11.1.454.CMB.2.raw
  modified_base (199)..(199): a, c, t, g, unknown or other
  misc_feature (199)..(199): n is a, c, g, or t
  modified_base (572)..(572): a, c, t, g, unknown or other
  misc_feature (572)..(572): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgacccagtctccatccctccctgtctgcatctgtagganacagatcacatctactcgaccgaggcgagtacgaggactagttagactaaatttaattaaagtggtactacgaagtaccgtaaaccggaaaaccccggaactaccccgtaaagtccttaccgtaggtaaccttcccgtagtactcgtaccctttaatttaccgtaacggtttaacgggaaaccggtcggggtacccaagttacggtaacggttcgaggggtacggggaacgttcggcgttacgggtagggtaacttaacgttttacttttaccctacaaacctactacgaacgtcgacgtcgtacgaccgtacgtaccgtaggaagttacttacgttacgaacttaaacgttaatttacgttactacgttaanaaacgtacgttaactaaacttaccgtcccgttacccgtacgttccggtaacgggttccgggggacgggggtaaaccgttaagggtaacggaacgttaacgttaaccgttaaacggtaacggtcggttaacgcggaccgaactccgttaatttcccg

SEQ ID NO: 322019 - DNA, 791 bp, Homo sapiens
  misc_feature: GZ8MTXP01CXX2O.52.77.G11.1.454.CMB.2.raw
  modified_base (200)..(200): a, c, t, g, unknown or other
  misc_feature (200)..(200): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgacccagtctccatcctccctgtctgcatcgtagtagganacgagacgtccactatctacgtcgaccgaggcgtagtacgagactagttaagacttaaattaattaagtggtactacgagaccgtaaaccggaaaaccccggaacctaccctaaacgtcctaccgtagtaccctaccgtacgtactcgtacctttattaccgttaacggtttaacgggaaaccggtcgggttacccctaagttacccggttaaggtttcggaggggtacgggtaagggtcgtccgtgggtaacgggtaactttaacggtttacctttactaccgaacctataccgacgtcgtacgtccgtaacgccgtacgtaccggtaaggtacgtaacgttacttaaccgaataaacgggtttaaacttaacgtttaaccgtaacggtaaacctaaaccggtaacgtaaacgtacctttaaaccgttccccgtacccgtacttaaccggggttaacccggggttaaccggggggaccgggtaaaccggttaaggggtaacggtaacgttaaacccgttaaacggttaaaaccgggtaaccggttgggtaaccgtaccgtacggttaacccctcgttaacgttttcccgg

SEQ ID NO: 322020 - DNA, 538 bp, Homo sapiens
  misc_feature: GZ8MTXP01CRHAQ.52.77.G11.1.454.CMB.2.raw
  modified_base (262)..(262): a, c, t, g, unknown or other
  misc_feature (262)..(262): n is a, c, g, or t
  modified_base (302)..(302): a, c, t, g, unknown or other
  misc_feature (302)..(302): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcctntggattcaccttcagtgtctatgacatgcacgtgggtccnccaggctcgaggcaagggggctggagtgggtgctagttatatcatatagatggaaataagattatactatgacagtactcggtagagggcctatcacctattccagtagacaactaccaagaacacgctagtatttgacaaatcgaactagacctgagtaagcttggaacggacgacggcttggttgttacttaacgtagttcgtacgtaacgttaagtccgaacgggtaaccggg

SEQ ID NO: 322021 - DNA, 684 bp, Homo sapiens
  misc_feature: GZ8MTXP01ACSKH.52.77.G11.1.454.CMB.2.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
  modified_base (360)..(360): a, c, t, g, unknown or other
  misc_feature (360)..(360): n is a, c, g, or t
  modified_base (405)..(405): a, c, t, g, unknown or other
  misc_feature (405)..(405): n is a, c, g, or t
  modified_base (595)..(595): a, c, t, g, unknown or other
  misc_feature (595)..(595): n is a, c, g, or t
  modified_base (627)..(627): a, c, t, g, unknown or other
  misc_feature (627)..(627): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagctggtggagtcgtgggggagcgtggtccagccgtgggacgtccctgagactctcctgtgcagcctctggattcaccttcagtntctatgacatgccacgtcgggtcccncgaggctccgaggccgaagggggcttgggaggtgggtggctaaggtttanatcaattagtggaagttaagggaaattaaacgattaagtaacttntacgactaacgtaccgttcccggttaggaaacggggtcccgtaatttacccgaaccgttactttacccgaacgtaacgaaacccgtaaaccttaacccggaaaacggtaaaccgtaacccgttaccgttaggtttaaacttttacggaacctaaaagttaccggaaacctacggtacccgtaggaacggngtaccgttaggaaacgggttacgaccggggtnttggttcgttattaacgtagtcgtaacgtaacgtttaacgtcgaacgggtaaccggg

SEQ ID NO: 322022 - DNA, 623 bp, Homo sapiens
  misc_feature: GZ8MTXP01CBW57.52.77.G11.1.454.CMB.2.raw
  modified_base (267)..(267): a, c, t, g, unknown or other
  misc_feature (267)..(267): n is a, c, g, or t
  modified_base (307)..(307): a, c, t, g, unknown or other
  misc_feature (307)..(307): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggccgtgggacgtccctgagactctcctgtgcagcctntggattcaccttcagtgtctatgacatgcacgtcgggccncaggctccgaggcgaagggggctgggagtggggtgactagttatagtcaatagtagaagtaagggaaagtaaacgattaagtactagtgactacgtacgtccggtaggaacgggccgtattaccaccgtattaccaaggtaacaacaactaccgaaagtaactacgtcctagttaattacgaactaaagtacgaacgtaacgaccgtaggaacggtaacgtacggacggaaggaccgtaacggtcgttacggttaggttacttaaggtcggtaacgtaacgtaaaccttaacggtaaccgaacggggtaaacccgg

SEQ ID NO: 322023 - DNA, 682 bp, Homo sapiens
  misc_feature: GZ8MTXP01BP3R5.52.77.G11.1.454.CMB.2.raw
  modified_base (198)..(198): a, c, t, g, unknown or other
  misc_feature (198)..(198): n is a, c, g, or t
  modified_base (282)..(282): a, c, t, g, unknown or other
  misc_feature (282)..(282): n is a, c, g, or t
  modified_base (305)..(305): a, c, t, g, unknown or other
  misc_feature (305)..(305): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgaccagtctccatccctccctgtctgcatctgtagganacagagtcacatcattgccaggcgagtacgaggactattagactaacttaattaaatggtatcagctacggaaacccggaaacncccctaaagcctcctgactccanatcgactatttaccacgtttacggaaacgtacggggtaccctagtacgtaaggtcgtaggtgggtaagtcggtcgtcgtcgggtaactagtttacttttaccttactaacctatctacgctacgtccttggactacggtacctagggtacggtattagttacggtaacctaaacggttaactttaactttaacgtacggtaaccctaaacgtaacggttaacgttaacttaacctcccgtttacccggacctttccgggtaacgggtttaccgggggacccgggggtaacgttaaacggggacgggtacgttaacgttaaccgaaaacggttaaccggtaggttaacggccgtacgttacctaaccttaacgtttcg

SEQ ID NO: 322024 - DNA, 706 bp, Homo sapiens
  misc_feature: GZ8MTXP01EI9WW.52.77.G11.1.454.CMB.2.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgcttctttttaagaggtgtccagtgtcaggtgcagctggtggagtcgtgggggagcgtggtccagccgtgggagtccctgagactctcctgtgcagtcctntggattcaccttnagttgtactatcgactatgcacgtcgggtcccncgacggctaccgaggccgaagggggctagggaggtggggtagcgtaagttagtatctaagtagtaagaagttaagggaaagttaaagtaacttaagttaaccgttaagtcgaacgtaacggtaccgttaccggaagggtaacggggtccctaagtttaccctaaccttatttacccgaaagtaacgaaacctaaacctaacccgaaacggtaaaccgtacgttacgtttacgttaacgtttagaaccttaaaagttaacgaaacacgggtaccttaggaacggaaggtcgttaacgggaccggttaacggaccggtactttgggttacgttaacgtttcgtaggttaacgtaacccgttaaagttaaccgtaaccggaaacgggtaacccgg

SEQ ID NO: 322025 - DNA, 581 bp, Homo sapiens
  misc_feature: GZ8MTXP01AZ2K1.52.77.G11.1.454.CMB.2.raw
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (313)..(313): a, c, t, g, unknown or other
  misc_feature (313)..(313): n is a, c, g, or t
  modified_base (364)..(364): a, c, t, g, unknown or other
  misc_feature (364)..(364): n is a, c, g, or t
  modified_base (476)..(476): a, c, t, g, unknown or other
  misc_feature (476)..(476): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagactctcctgtancagcctcgtggattcaccttnagttntctagtgactatcgcacgtcgggtccnccgaggcctaccgaggaccgaagggggctgggtaggtgggtgactagttanatcgatagagattggaaatagacttagactagcacagcgtacgagacggcgtactacactattccagacacaactacgaaacggtacacgtcttacgtaattgaacttaaanacgaactacgacgtaggacgaacgtcgacggacggacgtacggtcgttagttacgttacgtaacgtggtaacgtaacgtaacgttacgtaacgggaacgggaacg

SEQ ID NO: 322026 - DNA, 542 bp, Homo sapiens
  misc_feature: GZ8MTXP01DZXZX.52.77.G11.1.454.CMB.2.raw
  modified_base (195)..(195): a, c, t, g, unknown or other
  misc_feature (195)..(195): n is a, c, g, or t
  modified_base (273)..(273): a, c, t, g, unknown or other
  misc_feature (273)..(273): n is a, c, g, or t
  modified_base (322)..(322): a, c, t, g, unknown or other
  misc_feature (322)..(322): n is a, c, g, or t
  modified_base (475)..(475): a, c, t, g, unknown or other
  misc_feature (475)..(475): n is a, c, g, or t
  modified_base (538)..(538): a, c, t, g, unknown or other
  misc_feature (538)..(538): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctgactctcaggtgccagatgtgtcatcagatgacccagtctccatcctcctgtctgcatctgtagganacagacgtcaccatcacttgccaggcgagtcaggacattagctaaatattaaatgtatcagctacgaaacccggaaancccctaagcctactgactcctcgatgctattctaactttacgggaaacncggggtaccctagtacgtaaaggttcgaggtacggggaagtggtccgtgtagggactaggttattttacttcaactatcagcagccttgacacgtcgtagaggtatagttcacaactattattaccgtatacaactagtacaataactctccnctcgtaacgttcggggacggggtacagggtagagacgttacaaagggtcagtcgctgctaacnttcg

SEQ ID NO: 322027 - DNA, 769 bp, Homo sapiens
  misc_feature: GZ8MTXP01DNHMZ.52.77.G11.1.454.CMB.2.raw
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgaccagtctccactcctcctgtctgcatctagtaggagacagacgtcaccatcacttgccgaggcgagtaccaggactagttagactaaacttattaaatggtaacttcgaagacgtaacggaaaaccccggtaacacccctaaaggcctacctagacctccgtcgatgtacctattacgtacgtttacggaaacgtcgggtccccaagttaccgaaggttcgagggtacggtaacgttggcccgttagggtacgggaaaccctttaaggtttatttttacccttacgaaaccctagttaccgaacgtaccgcgtaccgttacgaccgtacgtccgtaggtaaacggtatttaacgttacgtaaacctaaacggtttaatttaacgtttaacccgtaacgttaaaccaaaacgttacggttaaaccgtaaacttaacccggttcccttaaaccccggtccgtttacccgggttaacccggggtttccggggggaaccgggggtttaaacccgaagggggtttaacccgggaagttaaaacccgttacggttaaaaacccggtgggttacgcgggttacccagggaacccctttccgttaagttttcccgg

SEQ ID NO: 322028 - DNA, 677 bp, Homo sapiens
  misc_feature: GZ8MTXP01BLKQA.52.77.G11.1.454.CMB.2.raw
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgacccagtcctccatccctccctgtctgcatctgtaggagacagacgtcacatcactgccaggcgagtcagactatagactaaacttaattaaagtgtatacgagtacgtaacggaaaccccggaacaccccgtaagcctactgtactccgtacgatcgtacttactttaccgtaacgtttaacggaaaccgtcggggtaccctaacgttacggtaaggttcgaaggtcggggtaaggttcggcgttacggtacgggtaacttacgtttacttttaacctacaactatccgacgcgacgtccgtgaccgtacgtacgtagaagtacttagtactaactaacgttatttaacgttactaacgtacctaaacgttacgtaactaacttaacctcccgtcccgtacgttaccggtaaccggggttaccggggacggggtaaacgttagggtaacgtaacgttaacgttaaccggaaacggtaacgttggaaccggttcaccgaacctctttaacgttccg

SEQ ID NO: 322029 - DNA, 671 bp, Homo sapiens
  misc_feature: GZ8MTXP01DAU68.52.77.G11.1.454.CMB.2.raw
  modified_base (204)..(204): a, c, t, g, unknown or other
  misc_feature (204)..(204): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgacccagtcctccactccctccctgtctgctatcgtagtagganacagactccaccatccacgttgcccgaggcgagtacaggactattagactaacttaattaattggtatcgaagtaccgtaaacggaaaccccggtaacaccccctaaagtccctccgtgaacttcccgtagatgtaccttattacgtacgtttaacggaaacgtcgggtaccctaagtacgtaaggttcgtagggtggtaacggtcgtcgtaggtacgggtacttagttaaccttttacgttacaccgtatcgacgtcacgccctagactacggtcgtagagtatacgtacacctaagtacttacttagtacgtacaaacgtacgtaacgttaactaccttaccgtccgtaccttaccgggtaaccgggttacgggggaccgggggtaaaccaaggggttaacgacgttaaaccgcgttaaaaaccggtcggtaggttccgacgtacgaccgtaaccaagtttcccg

SEQ ID NO: 322030 - DNA, 621 bp, Homo sapiens
  misc_feature: GZ8MTXP01BRNPE.52.77.G11.1.454.CMB.2.raw
  modified_base (179)..(179): a, c, t, g, unknown or other
  misc_feature (179)..(179): n is a, c, g, or t
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
  modified_base (370)..(370): a, c, t, g, unknown or other
  misc_feature (370)..(370): n is a, c, g, or t
  modified_base (400)..(400): a, c, t, g, unknown or other
  misc_feature (400)..(400): n is a, c, g, or t
  modified_base (582)..(582): a, c, t, g, unknown or other
  misc_feature (582)..(582): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgctcttttaagnggtgtccagtgtcaggtgcagctggtggagtcgtgggggagcgtggtccaggccgtgggacgtccctgagactctctgtgcngcctcgtggacttcaccttnagttgtactatgacatgcctacgtcggggtccnccaggctaccgaggcgaagggggctggggacgtggggtggctagttatatcaattntacgatgggaaagtaaagattattattagngtacagtactccggtaggacggtccgacttaccgtacctatttccgaaggaactaaccgaaacctacccgaaagggaactacggtaccttaggttatttacggaactaaagttacggaaactacgtaccgtagaaggcgtaacggttggacgttacgacggtcttggttcgttattaaccgnggttaacgaacggtaacttaacgtccgaacgggtaacgg

SEQ ID NO: 322031 - DNA, 783 bp, Homo sapiens
  misc_feature: GZ8MTXP01CCYUU.52.77.G11.1.454.CMB.2.raw
  modified_base (206)..(206): a, c, t, g, unknown or other
  misc_feature (206)..(206): n is a, c, g, or t
tcagcgcagtacgacacgaccggtgctcgatttagctagtcactcaaggggaaagggggagtcagtcccaaccaggacacagcatggacatgagggtccctgctcagctccgtggggctcctgctgctctggctctcaggtgctagatgtgtcatccagatcgacccagtcctccactccctcctgtctgctatcgtaggtagganacagactccacctatcacgttcgccgaggcagtacagactatagactaattattaagtgtatacgagacgtaaccggaaacccggaactaccccgtaagtccccccccctagtacgtactccctacgtactcgtacttacttaccgttaacggttacggaaacggtaccggtaccctaagtaccggtaaggtcggtagggtagggtaacggtcggtcgttcggtacgggtaacgttagttactttcttaccactacgtcgaacgacgtcgtccctaggaccgtacggtaccggtaggtaggttaacttacggttaacgtaaccttaaacggttaatttaacggtttaactacggttaaacctaaacgttaaccggtaacgttaaccttaacccgttcccttaccccggttaccgttaaccgggttaaccggggggtttaacccgggggaaccggggggtaaacccggttaaaggggtaaccggggtaacgttaaacccgggttaaacggaaaccgggttaacgggtacggtttcgggacccggtacttacccggttaaccgttcggttttaaccccg

SEQ ID NO: 322032 - DNA, 781 bp, Homo sapiens
  misc_feature: GZ8MTXP01CBXQD.52.77.G11.1.454.CMB.2.raw
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtagganacagagtcaccatcacttgccaggcgagtcaggacattagcaacttattaaattggtatcagctagaaacccggaancccctaagctcctgactcctcgatcgtctactttccgtaacgtttacgggaaaccgtacgggggttaccccctaagttaccgtaaagggtttccgaaggggttcgggggtaaacggttggggtcccgttacgggtacggggggtaaccttaaacgggtttaacgtttttttacccgtttaccgaaaccccttacttccgtaaacggtcccgtaaacggtccccgttacgggaccgtaaaccgggtccccgttacggggtaacgggttaattaacgtttacgggaaccctaaaccgtaaagtttaactttaaccgttaacggttaacctaaacgtaacgttaaaccggttaacttaaaccttcccgttaccccgtaccgttacccggttaaccgggtttaccgggggaccggggggtaaacccttagggggtaacggaacggttaacgttacggaaaacggtaacgttcggtaacggtaccgtacgggacctaaccgttaactttccg

SEQ ID NO: 322033 - DNA, 531 bp, Homo sapiens
  misc_feature: GZ8MTXP02GMFOQ.52.77.G11.1.454.CMB.2.raw
  modified_base (318)..(318): a, c, t, g, unknown or other
  misc_feature (318)..(318): n is a, c, g, or t
  modified_base (417)..(417): a, c, t, g, unknown or other
  misc_feature (417)..(417): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctaggaaaccccggaaagcccctaagctcctgatcctcgatgcattcactttggaaacnggggtccatcaaggttcagtgggagtggctcgtgggacagtattttacttcaccataagcagcctgcaggcctggagtatatgacaactattattactntacaacagtaacattaactcctcccgactactaaccggtttcggggaccgggggtaactaagggtaggagtacaacgaaacgtaacgtggtacgactcgaccaactacttctcg

SEQ ID NO: 322034 - DNA, 558 bp, Homo sapiens
  misc_feature: GZ8MTXP02GM7Q3.52.77.G11.1.454.CMB.2.raw
  modified_base (307)..(307): a, c, t, g, unknown or other
  misc_feature (307)..(307): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagttgtctatgacatgcacgtcgggtcccncaggcctccgaggcgaaggggctgggagtgggngcagttanatcatatgatgggaaataagatatactatgacagactcggtagaacgggccgtattacacctattaccagacgacaactaccaaagaacacgctagttattagacaaatagaaacagaccgtagaggagcgtaggaacggaccgacgggtccgtaggttagttaagttaacgtggtacgacgtaaaccttaagtaccgaacgggaaccgg

SEQ ID NO: 322035 - DNA, 538 bp, Homo sapiens
  misc_feature: GZ8MTXP02G494E.52.77.G11.1.454.CMB.2.raw
  modified_base (317)..(317): a, c, t, g, unknown or other
  misc_feature (317)..(317): n is a, c, g, or t
tcagcgcagtacgacacgaccggtgctcgatttagctagtcactcaagggaaaggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaatggtatcagctagaaacccggaagcccctaagcctcctgactcctcgatgctattcactttaggaaacncgggtccatcgaagttcaggtggagtggctgtgggactagtattttacttcactatcagcagcctgcagcgtgagatattagacaactattatactgtacaacgtagtacgaataactccgtacccgtcttaccgtaccggtttcggggaccgggggtaacctaagggtaggacgaaacgttaccgaaaacgaagtagtcggactacgacaccgatttccg

SEQ ID NO: 322036 - DNA, 499 bp, Homo sapiens
  misc_feature: GZ8MTXP02FRQA2.52.77.G11.1.454.CMB.2.raw
  modified_base (315)..(315): a, c, t, g, unknown or other
  misc_feature (315)..(315): n is a, c, g, or t
  modified_base (415)..(415): a, c, t, g, unknown or other
  misc_feature (415)..(415): n is a, c, g, or t
  modified_base (497)..(497): a, c, t, g, unknown or other
  misc_feature (497)..(497): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactattaaattggtatcagctagaaacccggaaagcccctaaagctcctgatcctcgatgcattcactttgaaacngggtccatcaagtcagtggagtggctctgggactagtatttttactttcaccatcagcagcctgcagcctagaggatattgacaaacattattactgtanaacagtacataatctacccgctcacgtttcggcgggggaccaagggtcgacgatacgaaacgaacgtgtacggctgcacctntc

SEQ ID NO: 322037 - DNA, 528 bp, Homo sapiens
  misc_feature: GZ8MTXP02JM3NW.52.77.G11.1.454.CMB.2.raw
  modified_base (196)..(196): a, c, t, g, unknown or other
  misc_feature (196)..(196): n is a, c, g, or t
  modified_base (272)..(272): a, c, t, g, unknown or other
  misc_feature (272)..(272): n is a, c, g, or t
  modified_base (430)..(430): a, c, t, g, unknown or other
  misc_feature (430)..(430): n is a, c, g, or t
tcagcgcagtacgacacgaccggtgctcgatttagctagtcactcaagggaaaggggagtcagtcccaaccaggacacagcatggacatgagggtccctgctcagctcctggggctcctgctgctctggctctcaggtgccagatgtgtcatccagatgacccagtctccatcctccctgtctgcatctgtagganacagagtcaccatcacttgccaggcgagtcaggacattagcaactattaaattggtatcagctacgaaaccggaancccctaagctcctgactcctcgatgctattcactttaggaaacacggggtccatcaagttcaggtggagtggctcgtgggactagtatttttacttacacctaatcagacagcctgacagcctagaggatattgacaactattactactgtaccaaanagtacataatcctaccgctccgtaacgtttcggggacgggggtaaccaaggggtcgagaactacgaaaacgtaacgtgtcggactgaccaccattccg

SEQ ID NO: 322038 - DNA, 597 bp, Homo sapiens
  misc_feature: GZ8MTXP02JWIZQ.52.77.G11.1.454.CMB.2.raw
  modified_base (263)..(263): a, c, t, g, unknown or other
  misc_feature (263)..(263): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctntggattcaccttcagtgtctatgacatgcactgggtcccgccaggcctccgaggctaaggggctgggagtggggtnacagttanatcatangagtgaagtaatatatatatagacacgacgtaccggtacggaacgggaccgtactactacctacttacctaacgacgaaccaaacctaaccgaaaccgaaccgaccgtacgtacgttaagtttacgtactaaacgtaacgaacgaacgacgtacgaaggacggtacgtaggacggacgacggtcgtacgttacgttacgttaacgtacggtacgtacgtaacgttaacgtacgtaacggacgg

SEQ ID NO: 322039 - DNA, 538 bp, Homo sapiens
  misc_feature: GZ8MTXP02JQULU.52.77.G11.1.454.CMB.2.raw
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccaggcctggggaggtccctgagactctcctgtgcagcctctggattcaccttcagtgtctatgacatgcactggggtcccnccaggctccgaggcaaggggctgggagtggggtggcagttanatcatatgatgggaaatagatatactatgcagactccgtagaacgggccgattcacctatttccagagacaactccaaagaacacgctagtattgactaaatgaactagcctagacgacgctaggaacggacacggtactggtagtattaacgtggttacgacggtaaacttaacgtcgaacggaacgg

SEQ ID NO: 322040 - DNA, 771 bp, Homo sapiens
  misc_feature: GZ8MTXP02H3UXX.52.77.G11.1.454.CMB.2.raw
  modified_base (258)..(258): a, c, t, g, unknown or other
  misc_feature (258)..(258): n is a, c, g, or t
  modified_base (306)..(306): a, c, t, g, unknown or other
  misc_feature (306)..(306): n is a, c, g, or t
tcagcgcagtacgacacgaccggtgctcgatttagctagtcactcaagggaaagggtctgggagaggagcccagcactagaagtcggcggtgtttccattcggtgatcagcactgaacacagaggactcacatggagtttgggctgagcttgggttttcctcgttgcttcttttaaggaggtgtccagtgtcaggtgcagctggtggagtcgtgggggagcgtggtccagcctggggacgtccctgagactctcctgncagcctctggattccacttcagtgtctatgacatgcacgtcgggtccnccgaaggcctaccgagggcgaaacgggggtctaggggaagggttgggggtacggtacgtaggtttaagtattactaagttagtaggtaagttagggggtaaaagttaaagaacgtttaataaccttagtacgaaccgaacgtacccgtacccggttagggtaaaccggggacccggtaaacgttttaccccaacccttaacgttttacccccgaaagggtacgtaaaacccaaacccggttaaccccaaaacggaaacccgtaaaccccgtcgttaacggtttaacgtttaggaaacctaaaacgttaggaaaacctaccggtaccgtagggtaaacggtaggaacccgttagggaacggaaccggaaccgggttcgttacgggttactttaagttttaaccgacggttaggtaaaacccgtttaaaagtttaacgttaacccgggtaaacgggtaaacccgggg

SEQ ID NO: 322041 - DNA, 522 bp, Homo sapiens
  misc_feature: GZ8MTXP02IDQYI.52.77.G11.1.454.CMB.2.raw
  modified_base (424)..(424): a, c, t, g, unknown or other
  misc_feature (424)..(424): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtaggagacagagtcacatccattgccaggcgagtcaggacattagcaactatttaaattggtatcagactagaaaccccgggaaagcccctaagctcctgatcctcgatgctattctactttaggaaactaggggtcccagtcaaggttcaggtggagtggctcgtgggactagtattttactttcacctatcagcagcctgcagctgagatattgacaacattattacgtntacaacagtacataactctaccgctcgtacgtttcgggcgggggaccgtaaagggtcggagacgtacgaaaacgaacgtgtaggctagccacacttcg

SEQ ID NO: 322042 - DNA, 607 bp, Homo sapiens
  misc_feature: GZ8MTXP02G4OQI.52.77.G11.1.454.CMB.2.raw
  modified_base (309)..(309): a, c, t, g, unknown or other
  misc_feature (309)..(309): n is a, c, g, or t
  modified_base (364)..(364): a, c, t, g, unknown or other
  misc_feature (364)..(364): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgcagcctctggacttccaccttcagttgtctatgacatgcacgtggggtcccnccgaggcctccgagggccgaaagggggctaggggaggtggggtggctaggtttanatcaattagtgaagttggggaaagttaagacttaatactaagtgacagtactccggtaggaacgggccgtattaccaacctatttacccaagacgaaccaactaccaaagaacacgacttagttaatttacgaactaaagtacgaactacgaccgtagaacgagcgtagacggacgacgggtctacggtagttaacgttcgtacggtacgtaaccgtaacgttaacgtacggaacggaacggg

SEQ ID NO: 322043 - DNA, 516 bp, Homo sapiens
  misc_feature: GZ8MTXP02ITMYI.52.77.G11.1.454.CMB.2.raw
  modified_base (278)..(278): a, c, t, g, unknown or other
  misc_feature (278)..(278): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtaggagacagagtcaccatcacttgccaggcgagtcaggacattagcaactatttaaattggtatcagctagaaaccccgggaaancccctaagctcctgactcctgatgcattcactttggaaacaggggtcccatcaaggttcaggtgggagtggctcgtgggactagtattttacttcacatcagcagcctgcagcctgagatattgacaaactattattactgtacaaacagtaacgtataactcctaccgctcgtacgtttcggggacgggggaccaaggtcggagaactcgaaaacgcgtagtcggctagcactactc

SEQ ID NO: 322044 - DNA, 508 bp, Homo sapiens
  misc_feature: GZ8MTXP02JOEJE.52.77.G11.1.454.CMB.2.raw
  modified_base (274)..(274): a, c, t, g, unknown or other
  misc_feature (274)..(274): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctagaaacccggaancccctaagctcctgatcctgatgcattcactttggaaacaggggtccagtcaaggttcagtggagtgctcgtgggactagtatttacttcacctatcagcagcctgcagctgagatattgacaactatattactgtacaacagtaacgataatcctccgctctaccgtttcgggcgggggaccagggtacggacgacgtacgaaacgtaacgtggtacggctggacaccattcg

SEQ ID NO: 322045 - DNA, 511 bp, Homo sapiens
  misc_feature: GZ8MTXP02IN07M.52.77.G11.1.454.CMB.2.raw
  modified_base (315)..(315): a, c, t, g, unknown or other
  misc_feature (315)..(315): n is a, c, g, or t
  modified_base (397)..(397): a, c, t, g, unknown or other
  misc_feature (397)..(397): n is a, c, g, or t
  modified_base (498)..(498): a, c, t, g, unknown or other
  misc_feature (498)..(498): n is a, c, g, or t
tcagcgcagtacgacacgaccggtgctcgatttagctagtcactcaagggaaaggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcagtcaggacattagcaactatttaaaattggtatcagctagaaacccggaaagcccctaaagctcctgatcctcgatgcattcactttgaaacngggtccatcaagttcagtggagtgctcgtggactagtattttacttcacatcaagcagcctgcagcctgagatattgacaanattatactgtacaacagtaacataatcctccgactctaacgtttcgggacgggggtaaccaaggggttgacggaactacgaaaacgaacgttgcggtaccncgaccactactcg

SEQ ID NO: 322046 - DNA, 645 bp, Homo sapiens
  misc_feature: GZ8MTXP02GQRLF.52.77.G11.1.454.CMB.2.raw
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctntggattcaccttnagtntctatgacatgcacgtcgggccncgaggcctcgaggcgaaggggctgggaggtggggtgactagttatatactaatagtagaagtaggggaaagtaaagtaattaactaacgtaatcgactaagtaccgttaccggtaggaaacgggtaccgtaacgttacccaaccttaactttacccgaagaaacgaaacctaaacctaaccaaaacgaaaccgaacgtacttagttaacttacgaactaaaagtacgaaacacgaccgtagaagacgacgtaggaacggaaccgaacgggtcgttacggtagttaacgttaacgttaggtacgtaaccgtaaaacgttaaacgtaccggaaacgggtaacgg

SEQ ID NO: 322047 - DNA, 541 bp, Homo sapiens
  misc_feature: GZ8MTXP02I15RI.52.77.G11.1.454.CMB.2.raw
  modified_base (272)..(272): a, c, t, g, unknown or other
  misc_feature (272)..(272): n is a, c, g, or t
  modified_base (437)..(437): a, c, t, g, unknown or other
  misc_feature (437)..(437): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctcctgtctgcatctgtaggagacagagtcaccatcacttgccaggcgagtcaggacattagcaactattaaattggtatcagctagaaacccggaancccctaagctcctagactcctcgatcgactattcacgtttaggaaaccgtacggggtcccaagtacgtaagggttcaggtgggagtttgggcttcgtaggggactagtacttttactttcactatcacgcagcctgcagcctgagatatgacaacattacttacngtacaaactaggtactaataactcctccgctacgtacgttcggggacggggaccaggtcggacacgtacgaaaacgtcgtaggtcgacgtcgactacgattccg

SEQ ID NO: 322048 - DNA, 499 bp, Homo sapiens
  misc_feature: GZ8MTXP02I29CK.52.77.G11.1.454.CMB.2.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtagganacagagtcaccatcacttgccaggcagtcaggacattagcaactatttaaattggtatcagctgaaacccggaaagcccctaagctcngatcctcgatgcattcactttgaacaggggtcccatcaagttcagtggagtggctctgggacagtatttactttcaccctattcagcagcctgcagcctgaggatattgacaacatattactgtacaacagtacataaatctaccgctctacgtttcggcgggggaccaagggtcggagaactacgaaacgaacgtggtacgctggcacattcc

SEQ ID NO: 322049 - DNA, 524 bp, Homo sapiens
  misc_feature: GZ8MTXP02GC4KO.52.77.G11.1.454.CMB.2.raw
  modified_base (290)..(290): a, c, t, g, unknown or other
  misc_feature (290)..(290): n is a, c, g, or t
  modified_base (318)..(318): a, c, t, g, unknown or other
  misc_feature (318)..(318): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctagaaacccgggaaagcccctaaagctccngactcctcgatgcattcactttgaaacnggggtccatcaagttcagtgggatgggctcgtgggacagtattttactttacaccatcagcagccctagcagcctgaggatattgactaaacatattacctgtacaaactagttacataaactcctaccgctctacgtttcggggacgggggaccaagggtacggacgacgtacaaacgaacgtgacggctaggaccactacttcg

SEQ ID NO: 322050 - DNA, 507 bp, Homo sapiens
  misc_feature: GZ8MTXP02FZ4QK.52.77.G11.1.454.CMB.2.raw
  modified_base (495)..(495): a, c, t, g, unknown or other
  misc_feature (495)..(495): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctagaaaccccgggaaagcccctaaagctcctgatcctcgatgcattctactttggaaacaggggtcccatcaagttcaaggtggagtggctcgtgggacagtattttacttcacctatcagcagctgcagctgagatattgacaatatattactgtacaacagtacataatctaccgctctacgtttcgggcgggggaccaagggtgacgtaactacgaaacgaacgtgtaggcngacacctattcc

SEQ ID NO: 322051 - DNA, 537 bp, Homo sapiens
  misc_feature: GZ8MTXP02GHC4X.52.77.G11.1.454.CMB.2.raw
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (450)..(450): a, c, t, g, unknown or other
  misc_feature (450)..(450): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagacaacttattaaattggtatcagctaggaaacccggaancccctaagctcngactccncgatgactattctacgtttaggaaacgtcggggtacccatacgtaaggttcaggtgggagtggctcgtaggactagtatttacttcactatcagcagcctgcngctgagatntnacaatatatctgtacaactagtaacgataactcctacccgntaccgtaacggtttcgggggacgggggtaaccaaaggggtacggataacaccgaaaacgaacgttggacggactcgacactattccg

SEQ ID NO: 322052 - DNA, 517 bp, Homo sapiens
  misc_feature: GZ8MTXP02JMT1H.52.77.G11.1.454.CMB.2.raw
  modified_base (197)..(197): a, c, t, g, unknown or other
  misc_feature (197)..(197): n is a, c, g, or t
  modified_base (315)..(315): a, c, t, g, unknown or other
  misc_feature (315)..(315): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtagganacagagtcaccatcacttgccaggcgagtcaggacattagcaactatttaaatggtatcagctacggaaaccggaagcccctaagctcctgatcctcgatgctattcatttggaaacngggtccatcgaagttcagtggagtggctcgtgggactagtattttacttcacctatcaagcagcctgcagctgagatatgcaaatattattactgtacaacagtacgtataactcctaccgtctactacggtttcggggacgggggtaacctagggtacggagacgtacgaaacgtaacgtggtacgctgactacgacttcg

SEQ ID NO: 322053 - DNA, 577 bp, Homo sapiens
  misc_feature: GZ8MTXP02H9RQR.52.77.G11.1.454.CMB.2.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
  modified_base (346)..(346): a, c, t, g, unknown or other
  misc_feature (346)..(346): n is a, c, g, or t
  modified_base (368)..(368): a, c, t, g, unknown or other
  misc_feature (368)..(368): n is a, c, g, or t
tcagcgcagtacgacacgaccggtgctcgatttagctagtcactcaagggaaaggggtctgggagaggagcccaacactagaagtcggcggtgtttccattcggtgatcagcactgaacacagaggactcaccatggagtttgggctgagctgggttttcctcgttgctcttttaagaggtgtccagtgtcaggtncagctgggtggagtctgggggagcgtggtccagccgtgggaggtccctgagactctcctgtgcagcctctggattcaccttcagtgtctatgacatgcacgtgggtccncaggctcgaggcaaggggctgggagtggggtggctagttanatcatatgagtaggagtaaagntaatactatgacagacgtccgtaggaacgggccgtattaccgacctatttcccaagacgacaacgtaccaagaacacgtctgtattgactaaatgaacagcctagagagcgtaggaacggactaaccggggtcgttacggttacgttaacgttacgtcggtacggtaacgttaaacgttaacgaccggtaacgggaaaccggtaaccgg

SEQ ID NO: 322054 - DNA, 533 bp, Homo sapiens
  misc_feature: GZ8MTXP02H8ZU7.52.77.G11.1.454.CMB.2.raw
  modified_base (236)..(236): a, c, t, g, unknown or other
  misc_feature (236)..(236): n is a, c, g, or t
  modified_base (270)..(270): a, c, t, g, unknown or other
  misc_feature (270)..(270): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
tcagcgcagtacgacacgaccggtgctcgatttagctagtcactcaagggaaaggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcagtcaggacattagnaactattaaatggtatcagctagaaacccggaancccctaagctcctgactcctcgatgcattcactttggaaacaggggtccatcgaagttcagtggagtggctcgtgggactagtattttacttcaccatcagcacncngcngcgngagtatatanatactatattactacgtactaacagtacgtaatactactaccgtacgtacgtacggttacggggtacggggtacggtaacggtacggtacgacgtaacgaaacgtaacgtacgtacggtacgtacgacgtactactacg

SEQ ID NO: 322055 - DNA, 618 bp, Homo sapiens
  misc_feature: GZ8MTXP02GJZOG.52.77.G11.1.454.CMB.2.raw
  modified_base (281)..(281): a, c, t, g, unknown or other
  misc_feature (281)..(281): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtaggagacagagtcaccatcacttgccaggcgagtcaggacattagactaacttatttaaattggtatcagctacggaaacccgggaancccctaagcctcctgactcctacgatcgactactttaccgtaacgttttagggaaaaccgtacggggtacccccaagttaccgtaaaggggtttccaaaggggttgggggacggttcgggtccgtacggtacgggggtaaccttaggtttaattttttaacctttacaaccctagttacgacgctaacggccctagacagccttaggaggtatattcgacctaaatattaatactagtactaaacgagtactaataactcctccgtctacgtaccggttcggggacggggactaaagggtcgagtactacgaacgtaagtcgtcgctcgacactatc

SEQ ID NO: 322056 - DNA, 518 bp, Homo sapiens
  misc_feature: GZ8MTXP02GMSSE.52.77.G11.1.454.CMB.2.raw
  modified_base (436)..(436): a, c, t, g, unknown or other
  misc_feature (436)..(436): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagctaactatttaaatggtatcagctagaaaccccgggaagcccctaaagctccctgactcctcgatgcattcactttaggaaacagggtccatcaagttcagtggattgctctgggacagtatttacttcaccatcagcagcctgcagcctgaggatattagcaacatattactagtacaaccatacgataactactccnctctacttcggtacggggaccggaacggtacggagaacgtacaaacgaaccgttacgaaggttcgtcggacactaacttccg

SEQ ID NO: 322057 - DNA, 571 bp, Homo sapiens
  misc_feature: GZ8MTXP02GRJ3I.52.77.G11.1.454.CMB.2.raw
  modified_base (264)..(264): a, c, t, g, unknown or other
  misc_feature (264)..(264): n is a, c, g, or t
  modified_base (303)..(303): a, c, t, g, unknown or other
  misc_feature (303)..(303): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccattgagtttgggctgagctgggttttcctcgttgctcttttaagaggtgtccagtgtcaggtgcagctggtggagtcgtgggggagcgtggtccagcctgggagtccctgagactctcctgtgcagccctntggattcaccttcagtgtctatgacatgcacgtgggccncaggctccgaggcaaggggctggagtgggngcagttanatcatatgatgggaaataagatactatatcgacagactccgtagaagggccgaattcacctactttaccaagacgaacaaacctaccaaagaaccacgtacttagttaatttagactaaaagtagaaacagaccgtagagagccgtaggacggaacgaacgggtctacggtagttaacgttaacgttagtacggtacgtaaaactttaaacgtaccgaacgggaaacggg

SEQ ID NO: 322058 - DNA, 488 bp, Homo sapiens
  misc_feature: GZ8MTXP02JDMU2.52.77.G11.1.454.CMB.2.raw
  modified_base (339)..(339): a, c, t, g, unknown or other
  misc_feature (339)..(339): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcagtcaggacattagcaactattaaattggtatcagctagaaacccggaagcccctaagctcctgatcctcgatgcattcactttgaacagggtcccatcagtcagtggagtggctgngggacagtattttactttcactatcagtcagcctgcagctgagatatgcaactatatactgtacaacagtacataactctccgatcacgttcggcggggtaccaggtggacacgtacgaaacgaacgtcgtacgactgcgaccattccg

SEQ ID NO: 322059 - DNA, 645 bp, Homo sapiens
  misc_feature: GZ8MTXP02HIO52.52.77.G11.1.454.CMB.2.raw
  modified_base (197)..(197): a, c, t, g, unknown or other
  misc_feature (197)..(197): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtagganacagagtcaccatcacttgccaggcgagtcaggacattagacaacttatttaaattggtatcagctacggaaacccggaaagcccctaaagcctctgactcctcgatgctatttcgaacttttaggaaaccgtacggggtacccaagtacgtaacggttcaggtggggagttcgggcttcgtgggacctagtactttttactacaccataccagacngtccngtcacgccgtagacggtatagtacgactaaactatttaacgttacctagtaaccaaacgtaacgtaacggtaacttaaacgttcccctacccgtaccgttaccgtttaaccgggtttacccgggggaccggggggtaaaccctaaacgggggttaggacgtaaacgttaaccgaaaacggtaactaggggtttacggacgtacggttaccgaccttaacgtttccg

SEQ ID NO: 322060 - DNA, 558 bp, Homo sapiens
  misc_feature: GZ8MTXP02I1K9Q.52.77.G11.1.454.CMB.2.raw
  modified_base (304)..(304): a, c, t, g, unknown or other
  misc_feature (304)..(304): n is a, c, g, or t
  modified_base (348)..(348): a, c, t, g, unknown or other
  misc_feature (348)..(348): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtgtctatgacatgcactgggtcccnccaggctccgaggccaaggggctgggagtggggtggctagttanatcatatgatgggaataagatagtactatgcagacgtcgtagaagggccgtattacaccgtactttaccagtacgacaactaccaaacgaacacgactagtattacgacaatagaaacagacctagacgagcgtaggacggaacgacggtcgtacgtacggttattaacgttgtacgtacggtaacttaacgtacgtaacggtaaacggg

SEQ ID NO: 322061 - DNA, 582 bp, Homo sapiens
  misc_feature: GZ8MTXP02INP9E.52.77.G11.1.454.CMB.2.raw
  modified_base (195)..(195): a, c, t, g, unknown or other
  misc_feature (195)..(195): n is a, c, g, or t
  modified_base (263)..(263): a, c, t, g, unknown or other
  misc_feature (263)..(263): n is a, c, g, or t
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
  modified_base (446)..(446): a, c, t, g, unknown or other
  misc_feature (446)..(446): n is a, c, g, or t
  modified_base (482)..(482): a, c, t, g, unknown or other
  misc_feature (482)..(482): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctctttaagaggtgtccagtgtcaggtncagctgggtggagtcgtgggggaggcgtggtccagcctgggagtccctgagactctctgtgcagcctntggattcaccttcagtgtctatgacatgcacgtgggtccncaggctcgaggcgaaggggctgggagtgggtggctaggtttanagtcatatgactaggggaaatagaattatactagcgacgagacgtccgtaggaacgggccgtattacgaccttattaccaagtacgacaaactacgaaanaacacgtcttagtaacttcgaactaaatcgaaaacncgtaccgtagaacgtacggacgtaggaacgggtacaacggtcttaggttacgttaagttaacgtagtacggtacgtaaagttacgtaccgaacggaacgg

SEQ ID NO: 322062 - DNA, 555 bp, Homo sapiens
  misc_feature: GZ8MTXP02IEHEG.52.77.G11.1.454.CMB.2.raw
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggagtccctgagactctcctgtgcagcctctggattcaccttcagtgtctatgacatgcacgtgggccnccgaggcctccgaggcaaggggctgggagtgggngcagttatatcatatgatggaaataagatatactatgcagtactccgtagaacgggccgtatttacacccttatttacccgaagacgaacctaaacctaccaaacgaactacgacttaggttaatttcgaactaaagtacgaacaagcctagaagtacgacgtggagacgacggtcgtgtattagtaacgtgtacgacgtaacttacgacgacggacg

SEQ ID NO: 322063 - DNA, 549 bp, Homo sapiens
  misc_feature: GZ8MTXP02GHNFS.52.77.G11.1.454.CMB.2.raw
  modified_base (305)..(305): a, c, t, g, unknown or other
  misc_feature (305)..(305): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtgtctatgacatgcacgtgggtcccnccaggcctccgagggccaaagggggctaggggagtggggtacgacgagtttatagtcattatggatggggaaataaagatagtactatgacagactccggtagaacgggcgattcacctattccgagacgacaactacaaagacacgctagtattcgacaatagaaacagacctagagagcgtaggaacggacacggctacgtgtataacgtgtacgacgtaactttaacgacgaacggaacgg

SEQ ID NO: 322064 - DNA, 564 bp, Homo sapiens
  misc_feature: GZ8MTXP02FUB0F.52.77.G11.1.454.CMB.2.raw
tcagcgcagtacgacacgaccggtgctcgatttagctagtcactcaagtgaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaatggtatcagctgaaacccggaagcccctaaagctcctgatcctcgatgcattcactttggaaacaggggtcccccatcgaaaggttcaggtggggagtgggctcgtggggactagtatttttacttctaccatcagcagccctgcagcctgaggattagttgacaacattattactgtacaaactagtacgaataactctccccggcttaccacgttttccggggaccggggggtaacccaaacggggttggaacgtacgtaacgaaaaccggtaaaccgtgggttacggggactttacggacgaaccgttaacg

SEQ ID NO: 322065 - DNA, 556 bp, Homo sapiens
  misc_feature: GZ8MTXP02HS7TI.52.77.G11.1.454.CMB.2.raw
  modified_base (325)..(325): a, c, t, g, unknown or other
  misc_feature (325)..(325): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctcctgtctgcatctggtaggagacagatcaccattcacttgccaggtcagtcaggacattagacaacttatttaaatggtatcagactacggaaaccggaacgaccctaagcctcagactcctacgatgctattcacgtttaggaaacgngggtaccatacgagttcgaggttggagtgctcgtggactagttatttactacacatcagcagcctgcagctagagtatatgactaaatattattactagtacaaatacgtaactaactaactcctccgtactaccgtacggttcggggaccggggaacctaagggtagacggtaactaaccgaaaaccggtaacgttggtaacggtccgtacgtaccacctaagtttcccg

SEQ ID NO: 322066 - DNA, 566 bp, Homo sapiens
  misc_feature: GZ8MTXP02GSEI6.52.77.G11.1.454.CMB.2.raw
  modified_base (272)..(272): a, c, t, g, unknown or other
  misc_feature (272)..(272): n is a, c, g, or t
  modified_base (402)..(402): a, c, t, g, unknown or other
  misc_feature (402)..(402): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaatggtatcagctagaaacccggaancccctaagctcctgactcctcgatgctattctacgtttaggaaacacggggtcccagtacgaaggtttcaggtggggagtggctgtagggactagttactttactttcacctatcagcagcctgcacgcngaggatattgactaaatattattactagttacaaacagttaacataaactcctacccgtctacccgtacggtttccgggggacgggggtaacccgtaggggtacggaacgtaacgtaaccgaaaacggtaacgtggtacggcgtacgccgtaacctagtttccg

SEQ ID NO: 322067 - DNA, 544 bp, Homo sapiens
  misc_feature: GZ8MTXP02HYXU1.52.77.G11.1.454.CMB.2.raw
  modified_base (258)..(258): a, c, t, g, unknown or other
  misc_feature (258)..(258): n is a, c, g, or t
  modified_base (306)..(306): a, c, t, g, unknown or other
  misc_feature (306)..(306): n is a, c, g, or t
  modified_base (344)..(344): a, c, t, g, unknown or other
  misc_feature (344)..(344): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtncagcctctggattcaccttcagtgtctatgacatgcacgtcgggtccnccgaggcctccgaggccgaaggggctgggacgtggggngcagttatagtcatatgatgggaaataagataagtactagtgcagactccgtagacggccgattcactattccagacgtaacaactaccaaagacacgctagtattgacaaatacgaacagctagaagcgtacgtaggacgacgacggtctgtagtagttaacgtgtacgacgtaaactttacgtacgtaacggaaccgg

SEQ ID NO: 322068 - DNA, 556 bp, Homo sapiens
  misc_feature: GZ8MTXP02GJTD8.52.77.G11.1.454.CMB.2.raw
  modified_base (310)..(310): a, c, t, g, unknown or other
  misc_feature (310)..(310): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtgggacgtccctgagactctcctgtcgcagcctctggacttcaccttcagtgtctatgacatgcacgtgggtcccncacggctccgaggccaaggggctggagtggggtgcagttatatcatatgatggaataagattatactatcgactagactccgtaggaaacggtccgtatccaacctatttacccagaacgacaactaaccaaagaaccagtactagtaattagactaaatcgaaacacgactagacgtagactggaacgacgacggtctagtgttattaacgtgtacgacggtaactttacgacgacggtaaacgg

SEQ ID NO: 322069 - DNA, 700 bp, Homo sapiens
  misc_feature: GZ8MTXP02IKYQ3.52.77.G11.1.454.CMB.2.raw
  modified_base (276)..(276): a, c, t, g, unknown or other
  misc_feature (276)..(276): n is a, c, g, or t
  modified_base (296)..(296): a, c, t, g, unknown or other
  misc_feature (296)..(296): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtaggagacagagtcaccatcacttgccaggcgagtcaggacattagcaatatttaaattggtatcagctacgaaacccggaaancccctaagctcctgactccngatgctattcacgtttagaaaccgtagggtcccagtcgaaggtctagtaggtggtgtcggtcgtcggtacggtacttagttttactttaccttacccaacttacgacgtacgaccgtaccgtacgtacgccgtaccgtaccggtaagggtaaccggtatttaacggttaccgaaaccttaaacgtttaatttaaacttaccgttaacgtaaaacctaaacgttaaacgtaaaccttaaacgttaaccccttaccccgttcccgttaaccgtttacccgggttacccgggggtttacccggggggaaacccggtaaaccgggggttaacgggtaacgggaaacgttaaaccgaaaccgtaaaacggtacggttaggacgtaccgtaccgaccgtaactttcccgg

SEQ ID NO: 322070 - DNA, 627 bp, Homo sapiens
  misc_feature: GZ8MTXP02GW7GS.52.77.G11.1.454.CMB.2.raw
  modified_base (285)..(285): a, c, t, g, unknown or other
  misc_feature (285)..(285): n is a, c, g, or t
  modified_base (310)..(310): a, c, t, g, unknown or other
  misc_feature (310)..(310): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctagtggagtcgtgggggaggcgtggtccagccgtggggaggtccctgagactctcctgtgcagcctctggacttcaccttcagtntctatgacatgcacgtcgggtcccncaggcctccgagggcgaagggggctaggggaggtggggtggactagttatagtcatatggaatgggaaataagacttaatactagtgacagacgtacccggtaggaacgggccgtacttacgaacctatttacccgaagacgaaccaaaccgtaccaaacgaaccgtacgtaccttacgttaatttacgaaccgtaaagtacgaaacgtacgaccgtagacgagacgtaggacggaacgaccggtactacggttagttaacgttaacgtaggtaacggtaccgtaaacgtttaacgtaccggaacgggtaaaccggg

SEQ ID NO: 322071 - DNA, 586 bp, Homo sapiens
  misc_feature: GZ8MTXP02IW6ZH.52.77.G11.1.454.CMB.2.raw
  modified_base (416)..(416): a, c, t, g, unknown or other
  misc_feature (416)..(416): n is a, c, g, or t
  modified_base (574)..(574): a, c, t, g, unknown or other
  misc_feature (574)..(574): n is a, c, g, or t
  modified_base (582)..(582): a, c, t, g, unknown or other
  misc_feature (582)..(582): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtaggagacagagtcaccatcacttgccaggcgagtcaggactatagactaaacttaatttaaattggtaatcagtaccgtaacggaaaccccggaaaccgcccctaagcctacctgactcctacgatgactattctaacgtttaggaaaccgcggggtaccactacgaaggttcgaggtggagttcggcgtgtagggacttagttattttactacacctatacngcacgtcctgactcgacctaggtagtatacttagactaaacatttatacgtactaacaaacgtacgtaacacttaaactcctacccgtctacgttaccggttacggggacgggggtacaagggtacgacgtactaaccgaagtaaccgttgacggacngacacgtnttcg

SEQ ID NO: 322072 - DNA, 795 bp, Homo sapiens
  misc_feature: GZ8MTXP02HX27P.52.77.G11.1.454.CMB.2.raw
  modified_base (196)..(196): a, c, t, g, unknown or other
  misc_feature (196)..(196): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctcctgtctgcatctgtagganacagacgtcacatccacttgccgaggcgagtcgaggactattagactaacttaatttaaagtggtaatacagtacgtaacggaaaaccccggaacgaccccgtaaagtcccttacccgtagtaaccttcccccgtaggtacgtacggtaccttaagtttaccttaacggttttaacggggaaaacccggtaccggggttaccccctaagtacccggttaaagggttccgaaaggggttcggggtaacggttcgggtaccgttccgggttaggggtaaacctcggtttttaaactttttacccctttactaaacccctagttacccgaaacggtcaaccggtcccttacgacccgtaacgtccgttaggaacgggtatttagttacggaaacctaaagttatttaacttacgtacgtaacccaaaagtcgtaaactaaattaacccttcccgtacccgtacgtttaccgttaacccgggtttacggggggaacccgggggtaaacctaaagggggttacgaaccgggtaaacgttaaaccggaaaacggtaacggtttcggaacgggtccctacggacccttaacggttaactttcccgg

SEQ ID NO: 322073 - DNA, 556 bp, Homo sapiens
  misc_feature: GZ8MTXP02GDOAA.52.77.G11.1.454.CMB.2.raw
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (430)..(430): a, c, t, g, unknown or other
  misc_feature (430)..(430): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctcctgtctgcatctgtaggagacagagtcaccatcacttgccaggcgagtcaggacattagcaactatttaaattggtatcagctagaaacccgggaaagcccctaaagctcctgactcctcgatgcattctactttaggaaactaggggtcccatccgaaaggtttcaggttggggagttggctcgtggggactagtatttttactttcaccatcagcagctgcanctgagatnttagccaaatatattacgtntacaaacagttacattaactccgtcccgattccgtaacgtttcgggggacgggggtaccctaaagggggtacggaacgtaacgtaacgaaaacgtaacgtcggtacggctacgacctaccacgttc

SEQ ID NO: 322074 - DNA, 578 bp, Homo sapiens
  misc_feature: GZ8MTXP02HUMW2.52.77.G11.1.454.CMB.2.raw
  modified_base (264)..(264): a, c, t, g, unknown or other
  misc_feature (264)..(264): n is a, c, g, or t
  modified_base (308)..(308): a, c, t, g, unknown or other
  misc_feature (308)..(308): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctntggacttccaccttcagtgtctatgacatgcacgtcgggtcccnccgagcctccgaggcaaggggctggagtggggtgctagttatatcaatntgatgggaaagtaagntaattacagtgacagacgtaccgtaggaacggcgattaccgacctactttaccgagtacgaacaaacctaccaaacgaaaccacgtacttagtactttaggaactaaagtacgaaacagtacctagagacgtacgtaggacggaacgccggtagtcgttagttagttaacgtgtacgacgtaaacgtttacacgtaacggaacgg

SEQ ID NO: 322075 - DNA, 649 bp, Homo sapiens
  misc_feature: GZ8MTXP02IBSUJ.52.77.G11.1.454.CMB.2.raw
  modified_base (287)..(287): a, c, t, g, unknown or other
  misc_feature (287)..(287): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgacccagtctccatcctccctgtctgcatctggtaggagacagagtcaccatcacttgccgaggcgagtcaggacattagactaaacttaatttaaatggtatcagtcgtacggaaaacccggaacncccctaagcctctagactcctgatcgtactattcacgtttaggaaaccgtcggggtacccagtaccgtaaggttcgagggtggagtcgcgtgtagggactagttacttttacttcacctatcagtcacgtcctgacacgtcgtaggaagtatagttacgactaaactaatttacgttacgtacgtaaccgtaaaacgtacggtaaacgtactaaaccttcccgtaccccgtccgttaacccggttaccggggtttaccgggggaaccgggggtaaaccgtaaacgggggttaggaaccgtaacgttaaacccggaaaacggtaacgtcgggtaacggctacggaccctaacgttactttccg

SEQ ID NO: 322076 - DNA, 766 bp, Homo sapiens
  misc_feature: GZ8MTXP02F5Q85.52.77.G11.1.454.CMB.2.raw
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactattaaattggtatcagctacgaaacccggaagcccctaagctcctgactcctcgatcgctattcctaacgtttacggaaaacctacgggggtaccccaacgttaccgaaacgggtttccaaagggttggggaacggttgggtccgttacggttacgggggtaaccgtaaacgggttaacgtttttttaacgtttaccgtaaacccgttaaactttccgaaacggttccgaaacggtccccgttaagggtccaaacgggtccccgtttaaggggaacgggttaaagttacctttaagggaacctaaaaccgtaaatttaacggtttaacccttaagggttaaccaaaaccgtaacggttaaacccgtaatttaaaaccgtcccttaccccggtaccttacccgttaaccggttttacccgggggaccggggggaaacccgtaaaggggttacgaacgggtaaacttaaccgaaaacggtaaccggttaggttaacgggcgttacgacctaaccgtaacgtttccg

SEQ ID NO: 322077 - DNA, 572 bp, Homo sapiens
  misc_feature: GZ8MTXP02F926F.52.77.G11.1.454.CMB.2.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggacgtccctgagctctctgtgcagcctntggattcaccttnagtntctatgacatgcacgtgggtccncgaggctccgaggcgaaggggctgggagtgggtgctagttanatcaatatgatgggaaataagtactatactatgacagactcgagaacggccattacacctattccaagacgacaaactaccaaagaaccacgacttagttaattacgaactaaatacgaaacacgaccgtagaagagtacgtaggacggaaccgtaacggtcttaggtacgttaagttaacgtggtacgtaacgtaaactttaacgaccgaacgggtaaaccgg

SEQ ID NO: 322078 - DNA, 554 bp, Homo sapiens
  misc_feature: GZ8MTXP02IBY78.52.77.G11.1.454.CMB.2.raw
  modified_base (198)..(198): a, c, t, g, unknown or other
  misc_feature (198)..(198): n is a, c, g, or t
  modified_base (283)..(283): a, c, t, g, unknown or other
  misc_feature (283)..(283): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtagganacagagtcaccatcacttgccaggcgagtcaggacattagactaacttatttaaattggtatacagctacggaaaccccgggaancccctaagcctccctagtactcctcgatgactattcacgtttaggaaacgtaggggtacccatacaaggttcaggtggagtcgctgtagggactagtactttttacttcgacctatcagcacgcctagtcacgtcctgaaggtattattagactaactattattactagtacaaactagtaacgataactccaccgtctccgtacgttcggggaccgggggtacaaggggtcgagactacaaacgtaacgtcggtagctagactactatcc

SEQ ID NO: 322079 - DNA, 648 bp, Homo sapiens
  misc_feature: GZ8MTXP02F9JYN.52.77.G11.1.454.CMB.2.raw
  modified_base (277)..(277): a, c, t, g, unknown or other
  misc_feature (277)..(277): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcagacatagcaacttattaaattggtatcagtactacggaaacccggaaancccctaagcctcctagactccctgatgactacttctacgtttacggaaacgtacggggtcccaagtacgtaaggttacgagggttgggagttcggcgtcggtgggaactagtttactttttaacttacctacctaattccgaaggtcaacggcccttaggaccacgtccgtaggaggtaatagttaggactaaactattacttacgtacgttaacaaactacgtaacgtaacttaacgtccgtacccgtctaccgttaaccggtttccgggggaaccgggggtaacctaaaggggttaggaacgtaaacgttaaccggaaaaacggtaaccgttaggtacggtacttacggaccctaccgtaactttcccg

SEQ ID NO: 322080 - DNA, 607 bp, Homo sapiens
  misc_feature: GZ8MTXP02JK3W0.52.77.G11.1.454.CMB.2.raw
  modified_base (279)..(279): a, c, t, g, unknown or other
  misc_feature (279)..(279): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagacaactatttaaattggtatcagctacgaaacccgggaaacnccccgtaagcctacctgactcctcgatgctattctactttaggaaactacggggtccacgtcaggttaaacacggtgggagtggctcgtagggactagttatttactttcactatcagctacgcctgcacgcctaggaggatattagacctaaatattaattaccgtgtaaccaaacgtacgtaacgtactaaacgttcccgtacccgtcctacgttacccggtttacgggggaccgggggtaaccgtaaggggttacggacgtaacgttaccgaaaaacggtaaccgtaggtttaccggacgttacggaccgaacctacgtttcccg

SEQ ID NO: 322081 - DNA, 641 bp, Homo sapiens
  misc_feature: GZ8MTXP02GFDPR.52.77.G11.1.454.CMB.2.raw
  modified_base (290)..(290): a, c, t, g, unknown or other
  misc_feature (290)..(290): n is a, c, g, or t
  modified_base (448)..(448): a, c, t, g, unknown or other
  misc_feature (448)..(448): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgacccagtctccatccctccctgtctgcctatctgtaggagacagacgtcacatcacttcgccgaggcgagtcgaaggacattagactaaacttatttaaatggtatcagacgtacggaaacccggaacnccccgtaagcctcctagactcctgatcgactattctaacgttaggaaaccgcgggtaccagtcgtaaggtcgagggtcggaggtcgcgtcggagtacgttagttactttacttaccactactcgaagtccacgtcctcgacaccgtagtaggatactntaacgacctaattactattacgacgtataaaccgtagtactaataaccgtcctaaccctcgttaccgtaaccgggggtttccgggaaaccgggggtaacgtaacgggtaacggtacgtaaacccgtaacgggtaaaacccgtaaggttacggtacggttacggacccgtaaactcccggttaatttcccccgg

SEQ ID NO: 322082 - DNA, 622 bp, Homo sapiens
  misc_feature: GZ8MTXP02F6CMU.52.77.G11.1.454.CMB.2.raw
  modified_base (282)..(282): a, c, t, g, unknown or other
  misc_feature (282)..(282): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagacaaacttatttaaattggtatcagactacggaaacccggaaacnccccgtaagcctcctagacttcctacgtatcgctattcctacgtttagaaacgtacggggtaccagtacgaacggtttcaggtggtaggtgggcgtcgtacgggactagttacttttactttacgacctagtacagcacgctgcgacgtcgtagacggtatattcgactaatattattactacgtaacaaacgtagtaacgaattaactccgtacccgtacttccgtacgggtttaccgggggaccgggggtaaaccggtagggtacgggtaacgtaaacgtaacgaaaacccggtaacgtgggtaccggtacgtacggtactaacccgttacgttaccg

SEQ ID NO: 322083 - DNA, 497 bp, Homo sapiens
  misc_feature: GZ8MTXP02FJD1W.52.77.G11.1.454.CMB.2.raw
  modified_base (465)..(465): a, c, t, g, unknown or other
  misc_feature (465)..(465): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtgagtctggggaggcgtggtccagcctgggaggtccctgagactctcctgtgcagcctctggattcaccttcagtgtctatgacatgcactgggtccgccaggctccaggcaaggggctggagtggggtggcagttatatcatatgatggaaagtaagatatactatgcagactccgtgaagggccgattcaccatttccagagacaactccaagacacgctgtatttgcaaatgacagcctgagagctgaggacacggctgngtataactgtgcgaacttaatacacggaacgg

SEQ ID NO: 322084 - DNA, 667 bp, Homo sapiens
  misc_feature: GZ8MTXP02H2PHC.52.77.G11.1.454.CMB.2.raw
  modified_base (198)..(198): a, c, t, g, unknown or other
  misc_feature (198)..(198): n is a, c, g, or t
  modified_base (501)..(501): a, c, t, g, unknown or other
  misc_feature (501)..(501): n is a, c, g, or t
tcagcgcagtacgacacgaccggtgctcgatttagctagtcactcaagggaaaggggagtcagtcccaaccaggacacagcatggacatgagggtccctgctcagctcctggggctcctgctgctctggctctcaggtgccagatgtgtcatccagatgacccagtctcactcctccctgtctgcatctaggtagganacagatcacatcactgacgaggcgagtacgaggactagtacgactaattaatttaagtgtatcgagtacgtaaccggaaacccggaaccgtaccccgtaagtccttaccgtacgtactccgtacgattcgtacttacgtttacgtacgttaaacgggaaaccggtaccggggtacctagtaccggtaaggttacggaggggttggggtacgtcggcgttacggtagggaaccttaagtttaactttttacctactaactcgtaacgacgctacgtccgacgacgtacgtacgtaggaacgttnttaaacgtgtaaaactaacgtaattttactacgtacgtaacgtaaagtaacggtaactactaactcccgttcgtaccgtaccgttacgggttaccgggggacgggtaacaaggggtcgaagtaaccgtaacgaacgtaagtcggtacgcgtacgactacctcgtcg

SEQ ID NO: 322085 - DNA, 753 bp, Homo sapiens
  misc_feature: GZ8MTXP02FRSH2.52.77.G11.1.454.CMB.2.raw
  modified_base (197)..(197): a, c, t, g, unknown or other
  misc_feature (197)..(197): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctcctgtctgcatctgtagganacagatcaccatcacttgccaggcgagtcaggacattagacaacttattaaattggtatcagacgtacggaaacccggaacgcccctaaagcctaccgtagactcccgtagactgactattccgtaacgtttacgggaaaccgtacggggttaccccaagttaccgtaaaggtttaccgagggttaggggtaacggttcggggtccgttaccgggtagggggtaaaccttaagggttttaaccttttttaaacccgttttaccgaacccgttaaacgtttacctaaacgggcctaaacgtccccgttagtacccgacgtacccgtttaaggaagggttaaacttaggtttacgaaaccctaaacttaattaaccgtttacttaacggttaaccaaaccgtaaggttaacgtaaactttaactccccggtaaccctcgttaacccggttaccgggtttaccgggggaaccgggggtaaccgtaagggtaccgaagggtaaacaacggtaaaaccgaacgtttagacgggtacgtacgaccgtaacctaggtttcccg

SEQ ID NO: 322086 - DNA, 603 bp, Homo sapiens
  misc_feature: GZ8MTXP02GDEAC.52.77.G11.1.454.CMB.2.raw
  modified_base (281)..(281): a, c, t, g, unknown or other
  misc_feature (281)..(281): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagactaattatttaaattggtatcagctaggaaaccccgggaaacncccctaagctcctagactcctcgatgctattctacgtttaggaaacgtcggggtacccatccgtaaggttcaggtggagtcggctcgtgggactagttacttttacttcacctatcaagcagcctgcacgctaggagtatagttacgactaaactattaacttagtacgtaacaaacgtaggtaaacctaattaaaccgtccctacccggtacttacccggttacgggtttaccgggggaccgggggtaaaccgtaaggggtacggaagtaacgtaaccgaaaagtcgttaggtcggacttcggacctaacgtacgtttccg

SEQ ID NO: 322087 - DNA, 603 bp, Homo sapiens
  misc_feature: GZ8MTXP02JJJUZ.52.77.G11.1.454.CMB.2.raw
  modified_base (196)..(196): a, c, t, g, unknown or other
  misc_feature (196)..(196): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctcctgtctgcatctgtagganactagagtcaccatccacttgccaggcgagtcgaggacattagacaacttattaaatgtatcagctacggaaacccggaacgacccctaagcctcctagactccgtcatcgactattacctagtttaacggaaacgtacggggtaccaactacgtaacgttcgaggtggagtggcgtcgtagggactagtcttttactctacagtcaggtcacgtctgacgacgaccgtaggacgtatgttagacctaactattaatttaactacgactaaacgacgtaaacgtataaaccttcctacccggtactaccgttaacggttccgggggaccggggtaaacgtaacggggtaggaacgacgttaacgaaaaccgtaacgtaggtacggactcggaactaccgtatttccg

SEQ ID NO: 322088 - DNA, 691 bp, Homo sapiens
  misc_feature: GZ8MTXP02IMSXV.52.77.G11.1.454.CMB.2.raw
  modified_base (179)..(179): a, c, t, g, unknown or other
  misc_feature (179)..(179): n is a, c, g, or t
  modified_base (292)..(292): a, c, t, g, unknown or other
  misc_feature (292)..(292): n is a, c, g, or t
  modified_base (317)..(317): a, c, t, g, unknown or other
  misc_feature (317)..(317): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcacatggagtttgggctgagcttgggttttcctcgttgcttcttttaagnggtgtccagtgtcgaggtgcaggctgggtggagtcgtggggggagcgtggtccaggccgtggggacgtccctggacgtctctcctgtcgcagcctgtgatccacttcaggttntctagtgacatgctacgtgggcccncgaggcctacgaggacgaaggggctgggacggtggggtcgactaggttatatacgaattagtcggaattacgggggtaaaataaacggtattataaccgttagacgtaacgtacgtaaccgtacccggtagggaaaccggggttacccgtaaacgtttacccgtaaccttaacgtttaccccgaaagggtaaaccgtaaacctaaaacccgtaacccgaaaacggaaacccttacggtaaccttacgggtttaatttaaacggactaaaacgttacgaacgtaacgtacgtagaacgtagacgtacggacgacgacggtcgttagtacgttattaacgtgtacgtaactaaacgtacgtaacgtacggaaacgg

SEQ ID NO: 322089 - DNA, 617 bp, Homo sapiens
  misc_feature: GZ8MTXP02JAIKX.52.77.G11.1.454.CMB.2.raw
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggcctggggagtccctgagactctcctgtgcagcctntggatcaccttcagtgtctatgacatgcacgtgggtccnccgaggctcgaggcaaggggctgggagtgggtgctagttanatcatntagatgggaaagtaagattaagacttaatcgactaagacgtaccggtaggaacgggaccgtaacgttaccaaccctatttaccccgaaggtaacaaccgtaaaaccttacccgaaacgaaaccgtaccgaccttacggttaatttacggaacctaaagtacgaaaagacgaccgtaggacgtaagcgtaggacggaccgaacgggtctaggtacgttaagttaacgtagtacggtaactaacgtaacgtacgaacggtaaaccgg

SEQ ID NO: 322090 - DNA, 693 bp, Homo sapiens
  misc_feature: GZ8MTXP02FR4DX.52.77.G11.1.454.CMB.2.raw
  modified_base (287)..(287): a, c, t, g, unknown or other
  misc_feature (287)..(287): n is a, c, g, or t
  modified_base (315)..(315): a, c, t, g, unknown or other
  misc_feature (315)..(315): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggtccagccgtggggaggtccctagagacctctcctgtgcagcctctaggtacttcacccttnagtgtctatgacatgctacgtgggtccnccgaggcctcgagggccgaaggggctgggaggtggggtaggctaggtttatatactagttatagaattggggaaagtaaagtattaacgttactaagtcgactaacgtaccgtaccggtaggaaacggggtcctaacgttaccaacccttacgtttaacccgaaggtaaacaacctaaacctacccgaaaacggaacccaaccgtccgttaaggttatttaccgggaactaaaattcggaaaaccctacggtaccgtagaacggtacggtacggtaggaaaccgggacgtacgggttacggttacgttacggtttaacgttaacggttacgtacggtaaaccgttaaacgttaacggtaccggtaaccgggtaaacgg

SEQ ID NO: 322091 - DNA, 632 bp, Homo sapiens
  misc_feature: GZ8MTXP02JBF6N.52.77.G11.1.454.CMB.2.raw
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgcccaggcgagtcaggactattagactaactatttaaagttggtatcagctacggaaaccccgggaaacgacccctaagctcctagactcctcgatcgctacttactacgtttaggaaccgacggggtacccagtacgtaaggttcagggtgggtacgtggcgtcgtaggggactagttactttttacgttacactactcacgcacgtcctagacaccgccgttaggacggtaatacgttacgaactaaactagtttaacttactacggttaaccaaacgtacggtaaactaacttaaactcccgtacccgtctacggttaccgggtttccggggacgggggtacctaaaggggtacggacgtaacgtaacgaaacgtaacggtagtacggacgttacgacctaaccgtgtttaccg

SEQ ID NO: 322092 - DNA, 579 bp, Homo sapiens
  misc_feature: GZ8MTXP02JQPLG.52.77.G11.1.454.CMB.2.raw
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
  modified_base (390)..(390): a, c, t, g, unknown or other
  misc_feature (390)..(390): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgacgacctccctgtcgcacgtcctctggtattccacctttcagtgtctatgacatgcacgtgggtcccncaggctccgaggcgaaggggtctgggagtggggngcgtagttatanctatagtgaagttaggaagtagtatagtacntgactagtactcggtaggacgggactattccgaactacgttaccaagtacaacaactacccaaagaacacggtactagttattagaactaacgacgaaacgcgactagaagagacgtaggacgacgacggtactggtagttaattcgtaagacgtacgtaaacttagtacggacggtaacggtaaaccg

SEQ ID NO: 322093 - DNA, 538 bp, Homo sapiens
  misc_feature: GZ8MTXP02I6BXF.52.77.G11.1.454.CMB.2.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
  modified_base (365)..(365): a, c, t, g, unknown or other
  misc_feature (365)..(365): n is a, c, g, or t
  modified_base (419)..(419): a, c, t, g, unknown or other
  misc_feature (419)..(419): n is a, c, g, or t
  modified_base (441)..(441): a, c, t, g, unknown or other
  misc_feature (441)..(441): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagnggtgtccagtgtcaggtncagctggtggagtcgtgggggagcgtggtccagcctgggacgtcctgagactctcngtncagcctctggattcaccttnagtgtctatgacatgcatggtccnccaggctcgaggcaggggctggagtggngcagttatagtcatagtgagtggaaatagatatactangtcagactccgtagacggctatcactattccagtacgacactacaagacacgtntagtattcgactaatcgaaacngacctagagacgtacgtaggacggaacgacggtatacggttagttacttaacgtcgttacgtaccggttaaacttacggtacgtaacgggtaaccgg

SEQ ID NO: 322094 - DNA, 733 bp, Homo sapiens
  misc_feature: GZ8MTXP02JTYQL.52.77.G11.1.454.CMB.2.raw
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcctctggattcaccttnagtttcatgactatgcactcggggtccnccgagctccgaggcaaggggctgggagtggggtggctaggttactatctatagtgtagtaggaggtaaagacttagttaactatacggactaaggtacccgtacggttaaggaacggggacccgtactttacccgaacccttagtttaccccgaagtaaacggtaaccctaaaccgttaacccgaaaagaaacccgtaaccggtactttaacgggtttattttaacggaacctaaaacgttacggtaaaaccgaaccggtacccgttacggaaaggttaacggaccggttaagggaaacgggaaacccggtaacggggtaccgttacgggtttaagtaaaccgttttacggttaaggttaccggtaaccgttaaaaaccgtttaaacggtaccggtaaaacggggtaacggggttaaaacccccgggg

SEQ ID NO: 322095 - DNA, 557 bp, Homo sapiens
  misc_feature: GZ8MTXP02H8H4J.52.77.G11.1.454.CMB.2.raw
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagactaaacttaatttaaatggtaatcagactacggaaaacccggaacgcccctaaagcctcctagactcctgatgctattcacgtttaggaaacgcgggtccatcgaagttcaggttggagtcgctgtaggactagttattttactctacctatacagtcgacgtcctgacgtacgcctagaggtattattagctaaatatttaatatactacaaataggtaactaatactcctacccgtacgtacgtacggtcggggtacgggggaacctagggtcgaagtacaacgaacgtaagtcgacgcgtagaccctaatcgttcg

SEQ ID NO: 322096 - DNA, 600 bp, Homo sapiens
  misc_feature: GZ8MTXP02HVLDQ.52.77.G11.1.454.CMB.2.raw
  modified_base (198)..(198): a, c, t, g, unknown or other
  misc_feature (198)..(198): n is a, c, g, or t
  modified_base (274)..(274): a, c, t, g, unknown or other
  misc_feature (274)..(274): n is a, c, g, or t
  modified_base (318)..(318): a, c, t, g, unknown or other
  misc_feature (318)..(318): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtagganacagagtcaccatcacttgccaggccagtcaggacattagcaactattaaatggtatcagctacgaaaccggaacnccctaagctcctgatcctcgatgctattcaacgtttaggaaacncggggtaccagtacaaaggtcagtgggagtggctgtggactagtattttacgtcacatcagcagctgacgcgcgtagaggattagtagacctaaatatttaattaactggttaaccaaatacggtaaactaattaactaccctaccggtcctacggttaccggtttaccgggggaaccgggggaaacccgtaaaggggttaccggaaaaggtaaccttaaacggtaaaaaccgaaccggtttggaacggttcggaacgtaccctaacggttaaccctttcgg

SEQ ID NO: 322097 - DNA, 634 bp, Homo sapiens
  misc_feature: GZ8MTXP02JT1HW.52.77.G11.1.454.CMB.2.raw
  modified_base (183)..(183): a, c, t, g, unknown or other
  misc_feature (183)..(183): n is a, c, g, or t
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgctcttttaagaggtntccagtgtcaggtgcagctggtggagtcgtgggggagcgtggtccagccgtggggacgtccctgagctctcctgtgcagtccctgtggtacttcacccttnagttgtctatgactatgcacgtcgggcccncgaggcctccgaggccgaggggtctgggagttggggngctagtttatntacgattatggaagtggaaagttaaagacttatactagtcgcaacgtacgtaccggtagggacggcccgtattaccacctacttaccgaagacgaaccaaacctaccgaaaacgaccgtaaaccgtgttacgttaatttacggaaactaaagtacgtaaacccaggtacctaggaacgtaccggacgtagggaccggagtacgggtccgttagttacggtattaacgtaggtacgaaccggttaaacttaacgtacggtaaccgggaaacgg

SEQ ID NO: 322098 - DNA, 647 bp, Homo sapiens
  misc_feature: GZ8MTXP02H7X5S.52.77.G11.1.454.CMB.2.raw
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctcctgtctgcatcngtagganacagatcaccatcacttgccgaggcgagtcagactattagactaattatttaaagtggtatcgagacgtaacggaaaaccccggaacgacccctaacgtcctacctagtacctcctacgatcgactacgtttactaacgtttaggaaaccgtacgggtaccacgtacgtaaggtttcgagggttgggaggtcgggtcgtacgtaggggaaccttaagtttaactttttaccttactacctacgtacacgtacagcccgttgacacggtacctaggaagtattacgtagtacctaaagtaacttagttactacgttaaccaaacgtacgtaactacttaaccttccacccgttacttacccggtaacgggtttccgggggaccggggtagtaaacgggtagaacgaacttaccgaaaacgtaagcgtaggactacgactactcgtttaccg

SEQ ID NO: 322099 - DNA, 585 bp, Homo sapiens
  misc_feature: GZ8MTXP02H5ZUC.52.77.G11.1.454.CMB.2.raw
  modified_base (196)..(196): a, c, t, g, unknown or other
  misc_feature (196)..(196): n is a, c, g, or t
  modified_base (271)..(271): a, c, t, g, unknown or other
  misc_feature (271)..(271): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaganacagagtcacatcacttgccaggcagtcaggacattagctaaatatttaaatggtatcagctagaaacccggaancccctaagctcctgactcctgatgctattcacgtttaggaaacgtcggggtacccagtacgaaggttcaggtgggagttggctcgtggggactagttacttttactacacctatcagcacgctgacagcctaggagtatattacgactaactatttattaccgtagtaaccaactaagtaacgtactaaacttcctaccgtacttaccgtaccggttttccgggggaccgggggttaccgtaaaggggtggtaacgaacgtaaccgaaaacggtaacgtcggttaagggcttacggacctaacctacgtttccc

SEQ ID NO: 322100 - DNA, 700 bp, Homo sapiens
  misc_feature: GZ8MTXP02FLYPX.52.77.G11.1.454.CMB.2.raw
  modified_base (267)..(267): a, c, t, g, unknown or other
  misc_feature (267)..(267): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccagccgtgggacgtccctgagactctctgtgcagcctntggacttcaccttcagtcgtctatgactagtgcacgtcggggtcccacgaggtcctccggagggacccgaagggggcttggggaacggtggggtggtacgtaaggtttaatactacgtaattaagtggaaagttagggggaaaagttaaaggtaaattaaaccttacgttaaatcggaaccgtagaccgtacccgggtaggaaacgggtccgtaacttaccgaacccttaactttacccgaaagtaaaccgaacctaaaacccgtacccgaaacgaaacccgtaccggtactttaagtttaacgtttagaaaccgtaaaacttagaaacctagaccgtaggaacgtacggcgtaggaacggaacggacggtacgttggtacttagttaacgttaggtacgtaacgtaacgtttaacgaccggaaggaaaccgg

SEQ ID NO: 322101 - DNA, 658 bp, Homo sapiens
  misc_feature: GZ8MTXP02IKR7C.52.77.G11.1.454.CMB.2.raw
  modified_base (163)..(163): a, c, t, g, unknown or other
  misc_feature (163)..(163): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (283)..(284): a, c, t, g, unknown or other
  misc_feature (283)..(284): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcgtgggttttccncgttagctctttaagaggtgtccagtgtcaggtgcagctggtggagtcgtgggggagcgtggtccagcctgggagtcctgagctntccngtgcagcctntggatcaccttnagtntctannacntgcacgtcggccncgagcctcgaggcgaaggggctgggagtggtgacgtagttatatgtatagtagtaagtaggtaaacgtaaagtaagttaactagtacgtagtcgaacgtaccgttaccgtacggaacgggtacccgtacgttacccgtaaccgtaacctttaaccgaacgaaaccgtaactaaacccgtaaccgaaaaccgtaaacgtaccgtaacgttacgtttaacgttaacgtaaacgaaacgtaaacgtaaacgaacgtaacgtacgtaacgtacgtacgtacggacggacggtacggtacgtacggtacgttacgttaacgttacgttacgtacgtaacgttaacgtaacgtaacggtaacgg

SEQ ID NO: 322102 - DNA, 599 bp, Homo sapiens
  misc_feature: GZ8MTXP02IG5EV.52.77.G11.1.454.CMB.2.raw
  modified_base (199)..(199): a, c, t, g, unknown or other
  misc_feature (199)..(199): n is a, c, g, or t
  modified_base (281)..(281): a, c, t, g, unknown or other
  misc_feature (281)..(281): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatcgtgtagganacagagtcaccatcacttgccaggcagtacaggactattagctaaattatttaaatggtaatcagctaggaaacccggaacncccctagcctctgactcctgatgactattcgtactttaggaaacgtacggggtccagtacgtacggtttcaggtagggtagtggtcgtccggtaggggaacttagtttaactttttacctttcaaccctattacgacgtacaacggtccctggacctacgctaggagtatattacgaacctaaattattacttactgtaaccaagagttaacataacttccgtaccctactcgtaaccggttcgggggacggggtactaaggggtacagaacgttacgaaaacgtaacgtgacggttacacgacctaaccgttactcg

SEQ ID NO: 322103 - DNA, 703 bp, Homo sapiens
  misc_feature: GZ8MTXP02F519I.52.77.G11.1.454.CMB.2.raw
  modified_base (206)..(206): a, c, t, g, unknown or other
  misc_feature (206)..(206): n is a, c, g, or t
  modified_base (540)..(540): a, c, t, g, unknown or other
  misc_feature (540)..(540): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgaccccagtcctccactccctccctgtcctgctatcgtagtagganacagtagtccaccatcacgttgaccgaggcgagtcaggactagttacgactaaagtttaatttaaagttggtatacgaacgtaccgtaaaccgggaaaaccccgggaacacccccgttaagcccttaccgtagtaacctcccgtagacttcgacttactttacgtaacgtttaacggaaaccggtaccgggtacccaagttcgtaaacgggttcgaaggggttggacgttgggtaccttggaacggggtaaacttaacgtttactttttaccctacggtacctactacgtacggacaccggtccacgtaccgcggtaccgttaggacgtaaatntacgtaaacaaactttaattacttataaaccgttacaaaactagtaactacttaaccggtccctaccggtcttacgtaccggggttacggggacggggtaaccgtaaggtaccggagtaacgaaccgtaacgaagtcggtacgctaccgacaccgtcttaccg

SEQ ID NO: 322104 - DNA, 660 bp, Homo sapiens
  misc_feature: GZ8MTXP02I5UKY.52.77.G11.1.454.CMB.2.raw
  modified_base (199)..(199): a, c, t, g, unknown or other
  misc_feature (199)..(199): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtcctgcatctgtagganacagagtcaaccatcacttgccaggcgagtcaggacattagcaactatttaaatgtatcagctagaaaccggaaagcccctaagctcctgactcctgatgcattcactttaggaaacaggggtcccagtaccaaggttcaggttgggaagtggcgtcgtaggggactagtacttttaactttacaccctaatcgagacacgtaccgtgacacgacccttaggaaggtattaagtttacggacctaaaactaactttaactttaacttacggtaacctaaaaaccgtaggttaaaacccaagttaaaactcccgttaccccgtcttaacccgttaccggttttaccgggggaccggggggtaaaccccgtaaaaggggttagggaaacgtaaaccgttaacgaaaaacgggtaaacgtttacggacggggtacttcggacccgttaaccgacttttaacccg

SEQ ID NO: 322105 - DNA, 620 bp, Homo sapiens
  misc_feature: GZ8MTXP02HARY8.52.77.G11.1.454.CMB.2.raw
  modified_base (256)..(256): a, c, t, g, unknown or other
  misc_feature (256)..(256): n is a, c, g, or t
  modified_base (307)..(307): a, c, t, g, unknown or other
  misc_feature (307)..(307): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtcctgagctctcctgncagcctcgtggattcaccttcagtgtctatgacatgcacgtcgggtacccnccgaggcctccgaggccgaaaggggctggggaggttggggcggactaggtttaactagtcaagttagtagagtagggaaagttaaagattaacgtactatgacagtactccggtaggaacggggacctagttaccaacctactttaccgaagtacgaacctaaaccaccaaacgaactacgacttagtactttagaacctaaaagtacgaaacacgaccgtagaagagcgtaggaacggaccgtaaggtcgtacgttcgtaagttaacgtcggtaacgtaccgtaaagtttaacaccggaaacggaaaccggg

SEQ ID NO: 322106 - DNA, 608 bp, Homo sapiens
  misc_feature: GZ8MTXP02JY1JP.52.77.G11.1.454.CMB.2.raw
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagcctctggacttcaccttcagttgtctatgacagtgcacgtcgggtcccnccgtaggcctccgaggcgaaggggctgggaggtggggtcggcgtagttatntacatagngatgggaaagtagatatactatgcagacgtcggtaggacggccgtattccgacctattccgaagtacgaaacgactaccgaaagaacgacgtactacgtttattacgactaaagtacgaaacacgtaccgtagacggtaaacgcgtaagggaacggtaccggtaccggtaccgttcggttaagttacgttaacgtggtaccgtacgttaacgtttaacgtacggaacggtaaaccggg

SEQ ID NO: 322107 - DNA, 807 bp, Homo sapiens
  misc_feature: GZ8MTXP02F5YX5.52.77.G11.1.454.CMB.2.raw
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtaggagacagagtcaccatcacttgccaggcgagtcaggacattagcaacttattaaattggtatcgagactaacggaaaaccccggaaacgtacccccgtaaagtcctacctaggaacttcccgtacgtaagtcgacttacttaccgttaacgttttaacgggaaaacgtaccgggggttacccctaagttaccgtaaacgggtttcgaaggggtttacggggaaggttcggggtccgttacgggtaacgggggtaaccttaaagggtttaacctttttttaaccgtttacccgtaaacccttaaacgttaccgtaaacggtaccaacggtcccgttacggtaccaccggtacccgtaagggtaacgggtaactttaaggtttaacgaaaccctaaaacttaaacgtttaagtttaaccctttaaggtaaaccaaaacccgttaaggttaaaccgttaaacttaaacccttcccgtaccccggtacttacccggttaaaccgggtttcccgggggaaccgggggtaacccgtaaagggttacgggaaacgtaacgttaaccggaaaacccgtaacggttaggtacgggtaccgtacgacctacccgtatttccg

SEQ ID NO: 322108 - DNA, 720 bp, Homo sapiens
  misc_feature: GZ8MTXP02H4IMM.52.77.G11.1.454.CMB.2.raw
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggtccagccgtgggacgtccctgagctctcctgtgcagcctntgnttccaccttcagtgtctatgactatgcctacgtcgggtcccaccgaggcctaccgagggaccgaaggggctaggggaggtggggtggactaaggttatacgtactaagttagtaggtaagtaggggtaaaagttaaaggtaattaacttaaccgtagtacggaaccgtaacgtaccgtaccgggttacgggaaacggggtacccggttaactttacccgtaacccgttaacgtttacccgaaacggtaacgaaacctaaacccgttaacccaaaacggtaaaccgtaaccgtaccgttaggttaacgtttaacggaacctaaaacgttacgaaacgtacgtacccgtaggaacggtacggtacgtaggaacggaaccggtacggtccgttacggttacgttagttaacgtcggtacgtacgtaaacgttaacgtaccgtaaacgggaaccgg

SEQ ID NO: 322109 - DNA, 699 bp, Homo sapiens
  misc_feature: GZ8MTXP02F0S4J.52.77.G11.1.454.CMB.2.raw
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtaggagacagagtcacatcacttgccaggcgagtcgagacattagactaacttatttaaatggtatacgagtactacggaaaacccggaacgcccctaaagccttacctagacttcccgtacgatcgactactttaccgtaacgtttacgggaaaaccgtacggggttacccctaagttaccgtaaagggtttcgtaaggggttggggtaggttcgggtcgttcggtaggggtaacttagttactttttacctaccacctattaccgagtaccgacgtcccgtagccgtacgtccgtaggaaggtattattacgaactaaacgtatttacgttactacgtacaaacgtacggttaactacttaacctccgtacccgtacttaccggttaccgggtttacgggggaaccgggggtaccgtaaagggggttacggaacgtaaacgtaaccgtaaaacgggtaaccgttaggttacggaccgttacggaccgtaaccttacgtttcccgg

SEQ ID NO: 322110 - DNA, 633 bp, Homo sapiens
  misc_feature: GZ8MTXP02IXJ7P.52.77.G11.1.454.CMB.2.raw
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (368)..(368): a, c, t, g, unknown or other
  misc_feature (368)..(368): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctgtgatcaccttnagtgtctatgacatgcacgtcgggtccncaggctccgaggcgaggggtctagggagtggggngctagttanatcatatgagtgggaaagtaanataatactaagtgacagtacgtccggtagaacggctagtacaccgtacttacgaacgaacgaactaaacctaaccgaaaacgaaaccgtaccgtaccgttaagtttaacgttaacgaacctaaaacgttacggaaaacctacgtaccgtagggtaagacggtacgttaacgggaacgggtaaaccgtaacgggtcgttacggttacggttaagttaaccgttagtacgtaacgtaaacgtttaacgacggaaacgggtaaaccgg

SEQ ID NO: 322111 - DNA, 681 bp, Homo sapiens
  misc_feature: GZ8MTXP02HGCT7.52.77.G11.1.454.CMB.2.raw
  modified_base (497)..(497): a, c, t, g, unknown or other
  misc_feature (497)..(497): n is a, c, g, or t
  modified_base (506)..(506): a, c, t, g, unknown or other
  misc_feature (506)..(506): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgaccctagtcctccactccctccctgtctgcatcgtgtaggagacagacgtccaccatctactgccgaggcgagtcaggactattagactaaattatttaaatggtatcgagacgtaacggaaaccccggaaactcccctaagtctacctagtacctccgtagatcgacttactttacgtaaccgtttaacgggaaaccggtaccggggtacctaacgtaccgtaaacgggtttcgaaggggttggggtacgttcgggccgttacggtaggggtaaccttagtttacctttttactaccgacctatcacgtcacgtcctagcacgtcgtagagtatntagactaanatttatcgattaccaaagttacgtaactaacttaacctccccgttaccgtacgttacccggttaaccgggggtttccgggggaaccgggggtaacgtaaacggggtaggtaacgtaaaccgtaacgtaaaacccggtggttacggacgtaccgtacgaccctaacgtcgtttacc

SEQ ID NO: 322112 - DNA, 583 bp, Homo sapiens
  misc_feature: GZ8MTXP02GOOW8.52.77.G11.1.454.CMB.2.raw
  modified_base (234)..(234): a, c, t, g, unknown or other
  misc_feature (234)..(234): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctcctgtctgcatctggtaggagacagagtcacatcacttgccaggcagtcagacatanacaattatttaaatggtatcagactacggaaacccggaacacccctaagcctctgactcctgatgctattctacgttaggaactcgggtccatacgtagttcaggtggagtggcgtcgtagggactagttactttacttcacctatcaagtcacgtcctgacgtacgccgtaggagttaactagtttacgactaaactattacttacacgtacaaactagtactaataacgtccctaccgtacgttaccggtacggttaccgggggaacggggtacctaaagggggtcgaaacggtacgtaaccgtaaaacggtaacgtggtacggactacggacctacctagtttccg

SEQ ID NO: 322113 - DNA, 603 bp, Homo sapiens
  misc_feature: GZ8MTXP02H7A3V.52.77.G11.1.454.CMB.2.raw
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
  modified_base (375)..(375): a, c, t, g, unknown or other
  misc_feature (375)..(375): n is a, c, g, or t
  modified_base (386)..(386): a, c, t, g, unknown or other
  misc_feature (386)..(386): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtggggggaggcgtggtccaggccgtggggacggtcccctggacgtactctcctgtgcagcctctggatcaccttnagttgctatgacatgcacgtggtccnccaggcctcgaggcaaggggctggaggtggggtgctagtatatcatatggatgggaataanattactatagngtcacgacgtccgtaggaacgggcccgattaccgtacctactttccaagtacgaacaaacctaccaaacgaaccagtacctagttacttcgaactaaacgttcgaaacgtacgaccgtagaacggagtacgtagaagggaccgtacgggacgtacggttagtaacgtttcgtaggttaacgtacggtaaaactttaacgtacgaaacgggtaaccgg

SEQ ID NO: 322114 - DNA, 641 bp, Homo sapiens
  misc_feature: GZ8MTXP02FNDCE.52.77.G11.1.454.CMB.2.raw
  modified_base (197)..(197): a, c, t, g, unknown or other
  misc_feature (197)..(197): n is a, c, g, or t
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgctcttttaagaggtgtccagtgtcaggtncagctggtggagtcgtgggggagcgtggtccaggccgtggggaggtccctgacgactctcctgtgcaggcctgtggacttcaccttcagtgtctatgactatgcacgtgggtcccncgaggctccgaggccgaaggggctagggagtggggtgctaggtttanatcattangaagtggaaagtaagtaatatactatcgactaagacttccggtaggaacgggtaccgtacgtttaccacccttaactttaccgaacgtaaacgaaaccgtaaacctacccgaaaacgaaccctaacgtaccgttagttaacgtttacgaacgtaaagtacgaaacgagtacccgtaggaacgtaggtacgagggaaaccggtacgaccggtcgttaggtacgttaacgttaagtcgtagtacgtaaactttaacgacggtaacgggtaaccgg

SEQ ID NO: 322115 - DNA, 662 bp, Homo sapiens
  misc_feature: GZ8MTXP02HJI46.52.77.G11.1.454.CMB.2.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (307)..(307): a, c, t, g, unknown or other
  misc_feature (307)..(307): n is a, c, g, or t
  modified_base (582)..(582): a, c, t, g, unknown or other
  misc_feature (582)..(582): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccattgagtttgggctgagctgggttttcctcgttgctcttttaagnggtgtccagtgtcaggtncagctggtggagtcgtgggggagcgtggtccagcctgggagtccctgacgctctcctgtgcagcctntggattccaccttnagtgtctatgacntgctacgtcgggtcccnctaggcctaccgagggcgaaggggtctggggaggttcggggtggactaggttaactagtcgtaattagtggaatagggggtaaaacttaaaggaattaacgtaacgttagtcgggacctaacggtaccgtacccggtagggaaaccggggtcccggtaactttacccgaaccgttaactttacccgaagaaccgtaacctaaaccgttaacccgaaaagtaaacccgtacggtaccgttaggtttaactttacgaaccgtaaaagtacggaaacncgtaccgtagaacgtgacgtagacggacgacggtctgtacgtataacgtgtacgacgtaaacttacgacgtacggaacgg

SEQ ID NO: 322116 - DNA, 714 bp, Homo sapiens
  misc_feature: GZ8MTXP02IGTMR.52.77.G11.1.454.CMB.2.raw
  modified_base (201)..(201): a, c, t, g, unknown or other
  misc_feature (201)..(201): n is a, c, g, or t
  modified_base (517)..(517): a, c, t, g, unknown or other
  misc_feature (517)..(517): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgacccagtctccatccctccctgtcctgcatcgtgtagganacagactacaccatcactgccaggcgagtgacggactaattagactaaattaattaaattggtatcgagtacgtaacggaaaaccccggaaccgtacccctaagcctcgtacgacctcccgtagactcgaccttacgttacctaaacggttttacgggaaaccggtaccggggtaaccctacgttaccggtaacgggttcgtaggggttgggagttcgggtcgtcggtaacgggtactagtttaactttttacctaaccacgtactacgtacgacacgtcctacgtacgacgtccgtaaggtaagtacttacgtanaaacgtaaactaactttattaccctaggtaacctaaacgtacggttaaactacgtttaaaccctcccgtacccgttaccgtaccggttaccggggttaccgggggaccggggaaacggtaaacgggggtacggtaacgtaaaccgtaacgtaaaacggccggttagttacggacccttacgactaccgtatttcccg

SEQ ID NO: 322117 - DNA, 614 bp, Homo sapiens
  misc_feature: GZ8MTXP02FPWRX.52.77.G11.1.454.CMB.2.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (457)..(457): a, c, t, g, unknown or other
  misc_feature (457)..(457): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtagganacagngtccacatcacttgccaggcgagtcgagacattagacaacttattaattggtatacagtactaggaaaccccggaacgcccctaagcctacctgactcctacgatcgactattactacgtttacggaaacgtacggggtacccaagttacgtaaggttcgaggtaggggacgttcgggctacggtgggactagtttactttactttcactacttcaagccagtcctgtacacgtccgtaggtagtactagttanaacctaactaattacttactagtaacaaccgtaaggtactaattacctcctaccgtaccgtacgtaccggggtttccgggacgggggtaaccgtaggggtacggacgaacttaacgaaacgtaacgtcggtacggtctacggacctaacatttcccg

SEQ ID NO: 322118 - DNA, 595 bp, Homo sapiens
  misc_feature: GZ8MTXP02IE1HL.52.77.G11.1.454.CMB.2.raw
  modified_base (303)..(303): a, c, t, g, unknown or other
  misc_feature (303)..(303): n is a, c, g, or t
  modified_base (351)..(351): a, c, t, g, unknown or other
  misc_feature (351)..(351): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctccctgtctgcatctgtaggagacagagtcaccatcacttgccaggcgagtcgaggacattagcaaacttatttaaatggtatcagctaacgaaacccggaacgcccctaagctctgactcctgatnactattcactttaggaaactggggtccctatacgaggttcaggtaggngtggctcgtggaactagttacttttacttcaacctagtcagtaccgacgtccctgaccacgttccgtagaaggttatagttcgactaaactattaatttacctagttacaacgtaaacgttataacttacttccgtacccgtcgttacggttaccgggttacgggggacggggtaacgtaaggggtacgaacgtacgtaacgaaaacgtaacggttcgtacgtacgtacgtacctacgtactcg

SEQ ID NO: 322119 - DNA, 702 bp, Homo sapiens
  misc_feature: GZ8MTXP02J1J14.52.77.G11.1.454.CMB.2.raw
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccaggccgtggggacggtccctgacgtactctccgtgtcgcagccctgtggtacttccacctttcagttcgttactatcgaacctatcggactaccggtcggggtccccgaccgacggtccccgtccgaacggggaccggaaagggggtccgtaggggtaggttgggggtcggacgttaagtttactgtacgtaattagtaggaagttagggaaagttaagaaacttagtactagtcgacacgtaccgtaccggtaggaacggtacccgtataccgacctaacttaccgaagtacgaaacctaaacgtaacccgaaagaacccgaccgtcgttaacgtttaccgttagaaccgtaaaatacggaaacgacgtaccgtaggaacgacgacgtacggaacgggacgaaccggtgttacgttagttactggttcgaacggttacgttaacgtttaacgaccggtaacgggtaaccgg

SEQ ID NO: 322120 - DNA, 632 bp, Homo sapiens
  misc_feature: GZ8MTXP02I0MMI.52.77.G11.1.454.CMB.2.raw
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (458)..(458): a, c, t, g, unknown or other
  misc_feature (458)..(458): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgacccagtcctccactccctccctgtctgctatctggtaggagacagactcacatccacttgccgaggcgagtacaggactatagactaaattatttaaatgtatcagtacgtaacggaaacccggaacncccctaagcctccngtactaccgtcgatcgactacttactaacgttacggaaaccggtcggtaccagtacgtaacgtcgaggtggtacgtcgtcgtcggtagggtactagtttacgttttacctacgtaccctatcgagcgacgtcctcgactcgactaggagtactntacgacctaaattacttattcgtaagtacaaacgtagttaactacgttaaccgttcccgtaaccctcgttaacccgggttaccggggttaccgggggaaccgggtaacgtaagggtacgaacgtaacgtaaccgaaacggtggtcgtacggcctaaggacccctagtatttccg

SEQ ID NO: 322121 - DNA, 599 bp, Homo sapiens
  misc_feature: GZ8MTXP02JBVQW.52.77.G11.1.454.CMB.2.raw
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (363)..(363): a, c, t, g, unknown or other
  misc_feature (363)..(363): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccaggcctggggacgtccctggagacctctcctgtgcagcctntggatcaccttcagtgtctatgacntgcacgtggccncagctcaggcagggctggngtggngctagttanatcatatggatggggaataacggnttaagtactagtagctacgacgtacgtacgggaaacggcccggtattaccacctacgtttaccgaacgtaacgaaccaaacgtacccgaaacgtaaacgaccgtacttacggttaactttacgaacctaaaagtacgaaactacgtaccgtaggaacgaggacgtaggacggtaacgacggtacgttcgtaggttattaacgtcgtagtacgtaacgtacgacgtacggaaaccgg

SEQ ID NO: 322122 - DNA, 648 bp, Homo sapiens
  misc_feature: GZ8MTXP02JU89G.52.77.G11.1.454.CMB.2.raw
  modified_base (279)..(279): a, c, t, g, unknown or other
  misc_feature (279)..(279): n is a, c, g, or t
  modified_base (320)..(320): a, c, t, g, unknown or other
  misc_feature (320)..(320): n is a, c, g, or t
  modified_base (558)..(558): a, c, t, g, unknown or other
  misc_feature (558)..(558): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagactctctgtgcagcctctggattccgaccttnagttgtactatcgacatgccacgtcgggtccgcacggtccnccgaggcccgaaggggctaggggacggtggggtacgcttaagttactagtatagtagtagaagttagggaaagttaagtattaataacttagaggaccaacggtaccgttaccggtaacgggtacggggtaccctaagttacccaaccgttactttacccgaaagtaccgaaacctaaacgtaacccgaaaacggtaacgacgtacgttaggttacttagaacctaaagtacgaaacngtacaggacaaggctaggaccggtaacgcggttacgtacgttagttacgtaacgtggtaacgtacgtaacgttacgaccggaacggaacg

SEQ ID NO: 322123 - DNA, 701 bp, Homo sapiens
  misc_feature: GZ8MTXP02FQI19.52.77.G11.1.454.CMB.2.raw
  modified_base (197)..(197): a, c, t, g, unknown or other
  misc_feature (197)..(197): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatccctcctgtctgcatctgtagganacagactcaccatcacttgcccaggcgagtcaggactattagactaaacttattaaattggtatacagtactaacggaaacccggaacacccctaagcctactagactcctacgatcgactattctacgttacggaaacgacggggtccagtaccgtaaggttacgaagggttggacgtggtccgtacggtaggggtaaccttagtttaactttttaccttaccaacccgtaattcgaaacggctaacggtccacgacgacgtccgttaggagggtacgtagttacgtaactaaacctaattaacttaaccgttagtttaacgaaaccgtaaagtaacgtaaacttaaacgttaacccgttaccctcccgttacccgttaaccggtttaccgggggttaaccgggggaaaccggggttaaaccgggtaagggtaacggtaaacgtaaccgtaaaaccgtaaacgaaggttacggtacggtacgtaccgaccgtaacgtttaccg

SEQ ID NO: 322124 - DNA, 639 bp, Homo sapiens
  misc_feature: GZ8MTXP02HY13N.52.77.G11.1.454.CMB.2.raw
  modified_base (300)..(300): a, c, t, g, unknown or other
  misc_feature (300)..(300): n is a, c, g, or t
  modified_base (328)..(328): a, c, t, g, unknown or other
  misc_feature (328)..(328): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatcgacccagtctccatccctcctgtcctgcatctgtaggagacagacgtcacatcacttcgccaggcgagtcaggacattagctaacttaattaagttggatcagctacggaaaacccggaagcccctaagctcagatcccngatgctattactacgttaggaaaaccgngggtacccagtacgtaagtcgaaggtggacgttggccgtgtagggactagtttaacttttaccttcaaccctatacgagtacacggtcctagacacgtcgttaggagtattaccgttagacttaaactattatttacgtagtaaacctaaggtacgtaacgtaattaacctcccgttaccgtacccgttacgttaccgggtttacgggggaccgggggaaaccttaacgggggttaagaccgtaaacgttaacccgaaaaggaacccgttggggttaccggacgtactaacccggtacctaaccggtttcg

SEQ ID NO: 322125 - DNA, 761 bp, Homo sapiens
  misc_feature: GZ8MTXP02FMFCV.52.77.G11.1.454.CMB.2.raw
  modified_base (257)..(257): a, c, t, g, unknown or other
  misc_feature (257)..(257): n is a, c, g, or t
  modified_base (317)..(317): a, c, t, g, unknown or other
  misc_feature (317)..(317): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgacgactctcctgtncagcctctggactttcgaccttcaggttgtactatggacagtgctacgttcggggtcccnccgtaggcctacccgagggcgaaacggggggccttagggggaaggtttgggggacgggtacctaacggggtttaaatacgtaccgtaaatttacggtaggtaattagggggaaaaggtttaaacgaagttaataaaccgtgttacgggacacgtaccgtacccggttaagggaaacggggtaccggtaacgtttacccgaacccttaacgttttaaccccgaagtaacccggaaaccgaaaacccttaccccgaaaacggaaacctaaccgtacccgtttaaggttaatttacggaacctaaaagttacggtaaaccacgttaaccgtagtaagggaaccgtaggtacggtaacggaaccgaacccgggtcgtttaggtaccgtttaagtaaccgttggttaccgaacgggttaactttaacggaccggaacggtaaacccggg

SEQ ID NO: 322126 - DNA, 691 bp, Homo sapiens
  misc_feature: GZ8MTXP02GPQ5E.52.77.G11.1.454.CMB.2.raw
  modified_base (140)..(140): a, c, t, g, unknown or other
  misc_feature (140)..(140): n is a, c, g, or t
tcagcgcagtacgacacgaccggtgctcgatttagctagtcactcaagggaaagggggagtcagtcccaaccaggacacagcatggacatgagggtccctgctcagctcctggggctcctgctgctctggctctcaggtnccagatgtgtcatccagatcgacccagtcctccatccctcctgtctgcatctggtaggagacagagtaccaccatcacttcgaccgaggcgagtcgaaggactaattacgactaaacttaatttaaagttggtactacgacgtaccgtacggaaaaccccggaaaccgtacccctaagtacctcctacgtacttacccgtcgtaactcgtaccttactttaccgttaacgtttaaacggggaaaccggtaccggggttacctaaccgtaacggtacggtttacgaaggggttcgggtagttcgggtcgtgtcggggtaaactagtttacttttaccgttacaccgtaattcgacgtcacgtaccctgactaccgcgtaggagtacttagtacgaacctaaagtacttacgttaactacgtaacaaacggtacgtacgtaataaccgtcccctaacgtcccgttacggttacggttccgggggacggggtaaccgtagggtcgaacgtacgtaaaccgaagtaacgtcgtacggctacgactacgatttccc

SEQ ID NO: 322127 - DNA, 707 bp, Homo sapiens
  misc_feature: GZ8MTXP02JH4AK.52.77.G11.1.454.CMB.2.raw
  modified_base (197)..(197): a, c, t, g, unknown or other
  misc_feature (197)..(197): n is a, c, g, or t
tcagcgcagtacgacacgaccggtgctcgatttagctagtcactcaagggaaagggggagtcagtcccaaccaggacacagcatggacatgagggtccctgctcagctcctgggctcctgctgctctggctctcaggtgccagatgtgtcatccagatgacccagtctccatccctcctgtctgcatctagtagganacagacgtcacatctactcgaccgtaggcgagtcaggactattacgactaacttaatttaaacgttggtactacgagaccgttaaaccgggaaacccggaaaccgtaccccgtaacgccttaccgtggaaccttacccgtcggtaactcggtaacctagtttaccgtaacggttttaaacggaaaccgtaccggggttaccacgttaaccggttaacggttaacgaggggttacggggtaacgttagggtcccgttaggtacgggtaaacgttaacggtttacttttacggtttaccactaacttcgaaacgcgtacgcccgtaagccgtaaggtccgtaggtaagtagttactacgtaacctaaattcggttaattactacgtaacaactagtaactatactcccgtaacctcgtaaccggttacggttacggggacgggtaaaccgagggtaggaacgtacgtaacccgaagtaacgtcggtcgtacggctaaccgtacgtactttcg

SEQ ID NO: 322128 - DNA, 763 bp, Homo sapiens
  misc_feature: GZ8MTXP02I9LRQ.52.77.G11.1.454.CMB.2.raw
  modified_base (652)..(652): a, c, t, g, unknown or other
  misc_feature (652)..(652): n is a, c, g, or t
  modified_base (669)..(669): a, c, t, g, unknown or other
  misc_feature (669)..(669): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagtcttgggttttcctcgttgcttcttttaaggaggtgtccagtgtcaggtgcagctggtggagtcgtgggggagcggtggtccagccgtgggagtccctagacgtacctctcctgtcgcagtcctcgtggtacttccacctttgagttgtcttaatgactagtcgctacggttcgggaccccgcgaggccctaccggagggacccgggtaaaggggtccgttggggtaggggttggggacggtactaaggtttactaactcgaaattaggtaggtaagggttaggggtaaaagttaaaggtaaccttaaagttaacgttagttagggaaccgtaaccgggttaacccgttaccggggaaggggaaccggggtacccttaacgtttaaccccaaccccggtttaattttaccccgaaagggaaaccgtaaccctaaaaccgtacccgaaaacgtaacccgtacgtacgtttacggttaatttaacgataaaacgtcgaaaacgnccggtaagaggtaccgngacggaacggaccgacggtactacgggttattacggttaagtacggttaacggtacgttaaacgttaaaccgtacgggaaacgggtaaaccggg

SEQ ID NO: 322129 - DNA, 757 bp, Homo sapiens
  misc_feature: GZ8MTXP02JPT9U.52.77.G11.1.454.CMB.2.raw
  modified_base (273)..(273): a, c, t, g, unknown or other
  misc_feature (273)..(273): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggtccgtgggacgtccctgacgtctctccgtgtcgcacgcctcgnggtattccgaaccttcgagttcgtctaagtcggactgtcgacctacggtccgggtcccgccgtaggtccctccggaagggtacccgaagggggtcgtaggggaggttggggtacggtactaggtttactacgtagtaagttaggtagtaagtacgggtaaaagtaaggtaactttaacgttaacgtaagtcggtaaccgtaaacggtaccgttaccgggttaagggaaaccgggtcccgtaaagttaccctaacccgttaacgtttacccgaaggtaaaccaaccgtaaaccctaccgaaagaaccctacgttacgtagttaacgttaacgaaccttaaaagcgaaaccgtaggtaccgtaaggacgtaggtacccgaagggaaaccggtacgaccgggtttacgtaccggtttattaaccgttaagtacggttaccgtaaaacgttaactttaaccggaaccggtaacggtaaaaccccgggg

SEQ ID NO: 322130 - DNA, 567 bp, Homo sapiens
  misc_feature: GZ8MTXP02FHE14.52.77.G11.1.454.CMB.2.raw
  modified_base (162)..(162): a, c, t, g, unknown or other
  misc_feature (162)..(162): n is a, c, g, or t
  modified_base (196)..(196): a, c, t, g, unknown or other
  misc_feature (196)..(196): n is a, c, g, or t
  modified_base (250)..(250): a, c, t, g, unknown or other
  misc_feature (250)..(250): n is a, c, g, or t
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (438)..(438): a, c, t, g, unknown or other
  misc_feature (438)..(438): n is a, c, g, or t
tcagcgcagtacgacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttccncgttgctcttttaagaggtgtccagtgtcaggtncagctggtgagtcgtgggggagcgtggtccagcctggggagtccctgagactcncctgtcgcaggcctctggacttcaccttcagtgtctatgacatgcacgtcggccncaggctccgaggcaaggggctggagtggngcagttancgtnatagngagtggaaataagacttagtaactatcgactagacttccggtaggaacgggccgtattccgaacctatttaccgagacgactaaacncccgaaaagactacgcttaggtattcgacaaatagaaacaggcctagaagcgtacaggaacggactacggtacgttagtacgttaacttaacgtgtacgacgtaaacctttaagacgacggtaaacggg

SEQ ID NO: 322131 - DNA, 543 bp, Homo sapiens
  misc_feature: GZ8MTXP01A1PWV.38.12.B01.1.454.CMB.2.raw
  modified_base (352)..(352): a, c, t, g, unknown or other
  misc_feature (352)..(352): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgctccaggggaagagccaccctctcgtgcagggccagtcagagtgttagtagcaggcacttagcctggtatcagcagaacctggccaggctcccaggctcctcatctatggtgttctagcagggccattggcatcccagacagattcagtggcaggtggtctagggacnggacttcacttctcaccatcaacagactggagccgtagaagtattttggcggttcttagtttctgttcaggtcagttatgtataccgttgtacggtacgtttcggaccgtaagggacccgaagggtaaggaaagttcgaaacgacgtggtcggacgttgaccaacatcgtgtcttactaacgttcctcccg

SEQ ID NO: 322132 - DNA, 525 bp, Homo sapiens
  misc_feature: GZ8MTXP01EQWRM.38.12.B01.1.454.CMB.2.raw
  modified_base (206)..(206): a, c, t, g, unknown or other
  misc_feature (206)..(206): n is a, c, g, or t
  modified_base (351)..(351): a, c, t, g, unknown or other
  misc_feature (351)..(351): n is a, c, g, or t
  modified_base (382)..(382): a, c, t, g, unknown or other
  misc_feature (382)..(382): n is a, c, g, or t
  modified_base (404)..(404): a, c, t, g, unknown or other
  misc_feature (404)..(404): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttatgacgcagtctccaggcaccctgtctttgctccgaggggaagagccaccctntcgtgcagggccagtcagagtgttagtagcaggcacttagctggtatcagcagaactggccaggctccaggctcctcatctatggtggttctagcagggccattggcatcccagacagattcagtggcagtgggtctaggggacnggacttcactctcaccatcaacagactggancctagaaagtattttgcggttnttatttctgtcaggtctagtatgataccgttgtggtacgttcggacaagggaccgaaggtaaggaaattcgaaaacgttacgtggtgcgttgaccaacatctgtcttactaacttctcccg

SEQ ID NO: 322133 - DNA, 507 bp, Homo sapiens
  misc_feature: GZ8MTXP01CXF6X.38.12.B01.1.454.CMB.2.raw
  modified_base (207)..(207): a, c, t, g, unknown or other
  misc_feature (207)..(207): n is a, c, g, or t
  modified_base (350)..(350): a, c, t, g, unknown or other
  misc_feature (350)..(350): n is a, c, g, or t
  modified_base (493)..(493): a, c, t, g, unknown or other
  misc_feature (493)..(493): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaagagccaccctntcgtgcagggcaagtcagagtgttagtagcaggcacttagcctggtatcagcagaaacctggccaggctcccaggctcctcatctatggtgttctagcagggcattggcatccagacagattcagtggcagtgggctgggacngacttcactctcaccatcaacagactggagcctgaagtattttgcggtctatttctgtcaggcagtatgataccgttgtggacgttcggccaaaggggaccaagggtggaaattcaaacgaactgtggcttgcaaccatcttntcttctcttctccg

SEQ ID NO: 322134 - DNA, 521 bp, Homo sapiens
  misc_feature: GZ8MTXP01BNVVW.38.12.B01.1.454.CMB.2.raw
  modified_base (207)..(207): a, c, t, g, unknown or other
  misc_feature (207)..(207): n is a, c, g, or t
  modified_base (288)..(288): a, c, t, g, unknown or other
  misc_feature (288)..(288): n is a, c, g, or t
  modified_base (354)..(354): a, c, t, g, unknown or other
  misc_feature (354)..(354): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaagagccaccctntcgtgcagggcaagtcagagtgttagtagcaggcacttagcctggtatcagcagaaacctggccaggctcccaggctcctnatctatggtgttcagcagggccagttggcatcccagacagattcagtggcaggtgggtctgggacngacttcactctcaccatcaacagactggagccgtagaagtattttgcggttcttatttctgtcagggctagtatgtataccgttgtggacgttcggaccgaagggaccaagggtggaaattcgaaacgacgtggtgcgttgcaacatctgtcttctaacttctcccg

SEQ ID NO: 322135 - DNA, 542 bp, Homo sapiens
  misc_feature: GZ8MTXP01B07FH.38.12.B01.1.454.CMB.2.raw
  modified_base (207)..(207): a, c, t, g, unknown or other
  misc_feature (207)..(207): n is a, c, g, or t
  modified_base (354)..(354): a, c, t, g, unknown or other
  misc_feature (354)..(354): n is a, c, g, or t
  modified_base (502)..(502): a, c, t, g, unknown or other
  misc_feature (502)..(502): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaagagccaccctntcgtgcagggccagtcagagtgttagtagcaggcacttagcctggtatcagcagaacctggccaggctcccaggctctcatctatggtgtctagcagggccattggcatcccagacagattcgagtggctaggtgggtctagggacnggactttcgactctcaacatacaacagacctggacgctagaacgttattttgcggttctatttctgtacgagtactagtatgacttaccgtggtggtacgttcggacgaagggacctaagggtaacgaaattcgaaacgttcgtaggnggcttgacaactatccgtgtcttcaacttccgttaacccg

SEQ ID NO: 322136 - DNA, 599 bp, Homo sapiens
  misc_feature: GZ8MTXP01DKTTU.38.12.B01.1.454.CMB.2.raw
  modified_base (145)..(145): a, c, t, g, unknown or other
  misc_feature (145)..(145): n is a, c, g, or t
  modified_base (207)..(207): a, c, t, g, unknown or other
  misc_feature (207)..(207): n is a, c, g, or t
  modified_base (288)..(288): a, c, t, g, unknown or other
  misc_feature (288)..(288): n is a, c, g, or t
tcagtcgatcacgtcacgaccggtgctcgatttagtagtgtagattccgcggggagagctgctcagttaggacccagagggaaccatggaaacccagcgcagcttctcttcctcctgctactctggctcccagataccaccgganacattttattgacgcagtctccaggcaccctgtctttgtctccgaggggaagagccaccctntcgtgcagggccagtcagagtgttagtagcaggcacttagccttggtatcagcagaaacctggcaggctcccaggctcctnatctatggtgttcagcagggccattggcatcccagacagattcagtggctaggtgggtctaggggactggaccttcgactctacaccatacaacagactgggacgcctagaagtattttggcgttctattcgtgtcaaggtctagttatgacttaccgttggtaggtaccgtttacggaccgtaaacgggggtacctaaaggggtaacggtaaaacttcggtaaaacgaacgttagggttacggacgttcggaccctaacccgtaagtcccttacggttccttaccgtaacctttcccgtttaacccccgg

SEQ ID NO: 322137 - DNA, 578 bp, Homo sapiens
  misc_feature: GZ8MTXP01ASD73.38.12.B01.1.454.CMB.2.raw
  modified_base (210)..(210): a, c, t, g, unknown or other
  misc_feature (210)..(210): n is a, c, g, or t
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccgaggggaagacgcccaccctntcgtgcagggccagtcagagtgttagtagcaggcacttagcctggtatcagcagaacctggccaggctcccaggctcctcatctatggtgttcagcagggccagttggcatcccagacagtattcagtggcaggtgggtctgggacngacttcactctcacatcaacngactggacnctagaagtntttgcggttatatttctgtacaggtctagtatcgtattccgttgtcggacgttcggaccgtaaagggacctaaggggtaacgaaacttccggaaaacgttacgttagggtacggcgttacgggaccctaacccgtagttccgtttcggttaccttaccgtaaccttccccggtttaaccccg

SEQ ID NO: 322138 - DNA, 627 bp, Homo sapiens
  misc_feature: GZ8MTXP01CM2SJ.38.12.B01.1.454.CMB.2.raw
  modified_base (209)..(209): a, c, t, g, unknown or other
  misc_feature (209)..(209): n is a, c, g, or t
  modified_base (283)..(283): a, c, t, g, unknown or other
  misc_feature (283)..(283): n is a, c, g, or t
  modified_base (356)..(356): a, c, t, g, unknown or other
  misc_feature (356)..(356): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagactattttatgacgcagtctccaggcaccctgtctttgtctccgaggggaagagcccaccctntcgtgcagggccagtcagagtgttagagcaggctactagcctggtatcagcagaacctggcaggctccagctcncatctatggtgtcagcagggccattggcatcccagacagacttcaggtggctaggtcggggtctaggggaccnggacctttcgacttctcgaacccataccgaaacagacgtaggacgccttaggaagttagttttcgggcggttacttacgttttctggttaccaggggtcctaaggttatcggaactttaccgtgggttacggtaccggtttcgggacccgtaaagggggaaccctaaagggggtaacggtaaaacgttaacgaaaacggttacgtaaggttggaccgttggacctaaccgtattccgttaggttcccttctaacgttcccgtttaaccccg

SEQ ID NO: 322139 - DNA, 551 bp, Homo sapiens
  misc_feature: GZ8MTXP01BUUXQ.38.12.B01.1.454.CMB.2.raw
  modified_base (210)..(210): a, c, t, g, unknown or other
  misc_feature (210)..(210): n is a, c, g, or t
  modified_base (287)..(287): a, c, t, g, unknown or other
  misc_feature (287)..(287): n is a, c, g, or t
  modified_base (356)..(356): a, c, t, g, unknown or other
  misc_feature (356)..(356): n is a, c, g, or t
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
  modified_base (432)..(432): a, c, t, g, unknown or other
  misc_feature (432)..(432): n is a, c, g, or t
  modified_base (538)..(538): a, c, t, g, unknown or other
  misc_feature (538)..(538): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttatgacgcagtctccaggcaccctgtctttgtctccgagggggaagacgcccaccctntcgtgcagggccagtcagagtgttagagcaggcacttagcctggtatcagcagaactggccaggctccaggctcctnatctatggtgttctagcagggccattcggacatcccagacagattcagtggcaggtgggtctagggacnggacttcgacttctacaccatcaaacagactggagcctagaagtnttttgcggttnttattctgtcaggtctagtntagtacttaccgttggtggaccgtttggaccgtaaaggggtacctaaaggggtaacgaaattcgaaaacgacgtggtaggcttggcctaaccagtcttgtcttacncgtttcctccccg

SEQ ID NO: 322140 - DNA, 576 bp, Homo sapiens
  misc_feature: GZ8MTXP01CWGKN.38.12.B01.1.454.CMB.2.raw
  modified_base (292)..(292): a, c, t, g, unknown or other
  misc_feature (292)..(292): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacatttttattgacgcagtctccaggcacccttgtctttgtctccgaggggaagacgcccaccctctcgtgcagggccagtcagagtgttagtagcaggcacttagcctggtatcagcagaaacctggccaggctccaggctcctnatctatggtgttctagcagggccagttggcatcccagacagattcaggtggcaggtgggtctaggggacngtacttcactcncaccatcaacagactggagcctagaagtattttgcggttcttatttctagtcaggtctagttatgtaattaccgttggtacggtaccgttcggacccgtaaaggggaccgtaaagggttaacggaaaacttcgtaaaacgacgttaggtcggacgttcgacctaacctattcgttcgttccttactaacgttcccttccccg

SEQ ID NO: 322141 - DNA, 577 bp, Homo sapiens
  misc_feature: GZ8MTXP01B0CKE.38.12.B01.1.454.CMB.2.raw
  modified_base (208)..(208): a, c, t, g, unknown or other
  misc_feature (208)..(208): n is a, c, g, or t
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
  modified_base (410)..(410): a, c, t, g, unknown or other
  misc_feature (410)..(410): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacatttttattgacgcagtctccaggcaccctgtctttgtctccaggggaagagccaccctntcgtgcagggccagtcagagtgttagtagcaggcacttagcctggtatcagcagaacctggccaggctcccaggctcctcatctatggtgttctagcagggccagttggcatcccagacagattcgagtggcaggtgggtctggggactggacttcactctcacatcaacngactganctgaagtntttgcgttctatttcngtcaggctagttatgacttaccgttggtcggtaccggttcggacccgtaaaggggtaccgtaaagggtaaggaaaacttcgtaaaacggaacgttgggtagggttccttcgggaccaacccgtagttccgttggttccctttaccgtaactttcccgttaacccccg

SEQ ID NO: 322142 - DNA, 675 bp, Homo sapiens
  misc_feature: GZ8MTXP01EA6YC.38.12.B01.1.454.CMB.2.raw
  modified_base (146)..(146): a, c, t, g, unknown or other
  misc_feature (146)..(146): n is a, c, g, or t
  modified_base (211)..(211): a, c, t, g, unknown or other
  misc_feature (211)..(211): n is a, c, g, or t
  modified_base (285)..(285): a, c, t, g, unknown or other
  misc_feature (285)..(285): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccgganactattttatgacgcagtctccaggcacccttgtctttgtctccgaggggaagacgcccaccctntcgtgcagggccagtcagagtgttagagcaggctacttagctggtatcagcagaactggccaggctccagctcnatctagtggtgttcagcgagggccagttcggactactcccgagaccagtacttcgaggttggactagggtgggtctaaggggaactggtacctttccgaacttcctacaacctattacccaaactgtaacctaggggactaccgttagtaaaacggttcgtttttcggaccggtttacttaagttttccgtaggttaccgtaaggggtacgttaaaggtttacgttacggtaacgtttaacccgtttgggttacggtaaccggtttccgggaaaccggtaaacggggtaccgtaaaggggtaacgtaaaacgttacgaaaacggttacgtaggtacggcttacggactaaccgtattcgttacgtccttactaaccgttccgttaacccg

SEQ ID NO: 322143 - DNA, 505 bp, Homo sapiens
  misc_feature: GZ8MTXP02IXZ97.38.12.B01.1.454.CMB.2.raw
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaagagccaccctctcgtgcagggccagtcagagtgttagtagcaggcacttagcctggtatcagcagaacctggccaggctcccaggcctcctcatctatggtgttctagcaggccagttggcatcccagacagattcagtgcagtggggtctggggacngcttcactctcacatcaanagactgagctagaagtntttgcgtcttattctgtcagcagtatgatacgttgtggcgttcggcgtaagggcaaggtagaaatacgaaacgaactgtcggactgacaacagtctcgtcttcacttccttcccg

SEQ ID NO: 322144 - DNA, 539 bp, Homo sapiens
  misc_feature: GZ8MTXP02JVMNY.38.12.B01.1.454.CMB.2.raw
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttatgacgcagtctccaggcaccctgtctttgtctccaggggaagagccaccctctcgtgcagggccagtcagagtgttagtagcaggcacttagcctggtatcagcagaacctggccaggctcccaggctcctcatctatggtgttcagcagggccagttggcatcccagacagattcagtggcaggtgggctggggacngcttnactctcaccatcaaacagactggagcctgaacgtatttcgcggttcttatttctgtcagtcagtatgataccgttgtggtacgttcggacctaaagggaccgaaagggtacggaaaagtacgaaaacgaacgttggtacgactacgacaaccgtataccgtgtaccttcacttccttccccg

SEQ ID NO: 322145 - DNA, 534 bp, Homo sapiens
  misc_feature: GZ8MTXP02FX0ZY.38.12.B01.1.454.CMB.2.raw
  modified_base (355)..(355): a, c, t, g, unknown or other
  misc_feature (355)..(355): n is a, c, g, or t
  modified_base (386)..(386): a, c, t, g, unknown or other
  misc_feature (386)..(386): n is a, c, g, or t
tcagtcgatcacgtcacgaccggtgctcgatttagtagtgtagatttcgcggggagagctgctcagttaggacccagagggaaccatggaaaccccagcgcagcttctcttcctcctgctactctggctcccagataccaccggagacattttattgacgcagtctccaggcaccctgtctttgtctccaggggaagagccaccctctcgtgcagggccagtcagagtgttagagcaggcacttagcctggtatcagcagaaacctggccaggctcccaggctcctcatctatggtggttctagcagggccagttggcatcccagacagattcagtggcagtgggtctggggacngacttcactctcaccatcaaacagactggancctagaagtattttgcggttctatttctgtcagtcagtatgattaccgttgtggacgttcggaccaaggggacctaagggtacggaaaatacgaaaacgtaacgtggtacggactgaccaaccgatctcgtctttcacttccttcccg

SEQ ID NO: 322146 - DNA, 565 bp, Homo sapiens
  misc_feature: GZ8MTXP02IXW3Z.38.12.B01.1.454.CMB.2.raw
  modified_base (206)..(206): a, c, t, g, unknown or other
  misc_feature (206)..(206): n is a, c, g, or t
  modified_base (352)..(352): a, c, t, g, unknown or other
  misc_feature (352)..(352): n is a, c, g, or t
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggagagccaccctntcgtgcagggccagtcagagtgttagtagcaggcacttagcctggtatcagcagaacctggccaggctcccaggcctcctcatctatggtggttctagcaggccagttggcatcccagacagattcagtgcagtgggtctgggacngacttcactctcacatcaacngactggagcctagaagtntttgcgttctatttctgtcagctagttatgacttaccgttggtaggtacgttcggccgtaaaggggacctaaaggggtacggaaaacgttacgaaaacggtaaacgttgggtacggacgttcggacctaaccgtattccgttcggttacctttcctactttcccgtttaccccg

SEQ ID NO: 322147 - DNA, 530 bp, Homo sapiens
  misc_feature: GZ8MTXP02GJYDC.38.12.B01.1.454.CMB.2.raw
  modified_base (207)..(207): a, c, t, g, unknown or other
  misc_feature (207)..(207): n is a, c, g, or t
  modified_base (287)..(287): a, c, t, g, unknown or other
  misc_feature (287)..(287): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
tcagtcgatcacgtcacgaccggtgctcgatttagtagtgtagatttcgcggggagagctgctcagttaggacccagagggaaccatggaaaccccagcgcagcttctcttcctcctgctactctggctcccagataccaccggagacattttattgacgcagtctccaggcaccctgtctttgtctccaggggaagagccaccctntcgtgcagggccagtcagagtgttagtagcaggcacttagcctggtatcagcagaacctggccaggctcccaggctcctnatctatggtgttcagcagggccattggcatcccagacagattcagtgcagtgggtctgggacngcttcactcncaccatccaaacagactggacgcctagaagtattttgcggttctatttctgtcagctagtatgataccgttggtggtacgttcggaccaagggaccaagggtacggaaaatcgaaaacgaacgtggtacggactggacaaccgtatcctgtccttacacttccttccccg

SEQ ID NO: 322148 - DNA, 555 bp, Homo sapiens
  misc_feature: GZ8MTXP02HUDZP.38.12.B01.1.454.CMB.2.raw
  modified_base (207)..(207): a, c, t, g, unknown or other
  misc_feature (207)..(207): n is a, c, g, or t
  modified_base (286)..(286): a, c, t, g, unknown or other
  misc_feature (286)..(286): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaagagccaccctntcgtgcagggccagtcagagtgttagagcaggcacttagcctggtatcagcagaacctggccaggctcccaggctcctnatctatggtgttcagcaggcattggcatcccagacagattcagtgcagtgggtcngggacngacttcactctacaccatcaacagactggacnctagaaagtnttttgcggttacttatttcgtagttcagtctaagttatagtacttaccgttggtcggtaacgttcggaccgtaaaggggaccctaaaagggttacggaaaacttacgaaaacggtaactacggtggactgacaaccgtatcctgtacttacactttccttaccccg

SEQ ID NO: 322149 - DNA, 506 bp, Homo sapiens
  misc_feature: GZ8MTXP02HIDYO.38.12.B01.1.454.CMB.2.raw
  modified_base (207)..(207): a, c, t, g, unknown or other
  misc_feature (207)..(207): n is a, c, g, or t
  modified_base (353)..(353): a, c, t, g, unknown or other
  misc_feature (353)..(353): n is a, c, g, or t
  modified_base (418)..(418): a, c, t, g, unknown or other
  misc_feature (418)..(418): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaagagccaccctntcgtgcagggccagtcagagtgttagtagcaggcacttagcctggtatcagcagaaacctggccaggctcccaggctcctcatctatggtggttctagcaggccattggcatcccagacagattcagtggcagtgggtctgggacngacttcactctcacatcaaacagactggagcctgaagtatttgcgtctattctgtcagctagtangtataccttgtggacgttcggccaaagggacaaaggtggaaaatcaaaacgactgtcggactgcaaccgatctgtacttcatctcccg

SEQ ID NO: 322150 - DNA, 486 bp, Homo sapiens
  misc_feature: GZ8MTXP02GZC8M.38.12.B01.1.454.CMB.2.raw
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (283)..(283): a, c, t, g, unknown or other
  misc_feature (283)..(283): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (416)..(416): a, c, t, g, unknown or other
  misc_feature (416)..(416): n is a, c, g, or t
tcagtcgatcacgtcacgaccggtgctcgatttagtagtgtagatttcgcggggagagctgctcagttaggacccagagggaaccatggaaaccccagcgcagcttctcttcctcctgctactctggctcccagataccaccggagacattttatgacgcagtctccaggcaccctgtctttgtctccgaggggaaganccacctntcgtgcagggccagtcagagtgttagtagcaggcacttagcctggtatcagcagaacctggccaggctccaggctcnatctatggtgtctagcaggccattggcatcccagacagatcagtgcagtggctgggangacttnactctcacatcaaacngactgancctgaaagtntttgcgttctattctgtcagctagtatgatacttgngtacgtgcagggacaaggtagaaaatcgaaaacgagtacgtgactgcaacatctagtctcacttctcccg

SEQ ID NO: 322151 - DNA, 605 bp, Homo sapiens
  misc_feature: GZ8MTXP02F4RY1.38.12.B01.1.454.CMB.2.raw
  modified_base (205)..(205): a, c, t, g, unknown or other
  misc_feature (205)..(205): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttatgacgcagtctccaggcacctgtctttgtctccaggggaagagccaccctntcgtgcagggccagtcagagtgttagtagcaggcacttagcctggtatcagcagaacctggccaggctcccaggctcctcatctagtggtgttctagcgagggcctagttggctactcccgagaccagtacttcgaggtggcagggttcggggtctaggggactaggtaccttcacttcctaccaacctatacaaacagactgggactcctagaagtagtttggcggttcttagtttctagtcagtctagttatagtacttaccgttggtacggtacgttacggaccgtaagggaaccgtaaagggtacggaaaacgtacgaaaacggtaacgttacggtacggtacgtagaccaacgtacgttcgttacggttcctttactactttacccgtttccccg

SEQ ID NO: 322152 - DNA, 525 bp, Homo sapiens
  misc_feature: GZ8MTXP02F6P1Y.38.12.B01.1.454.CMB.2.raw
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttatgacgcagtctccaggcaccctgtctttgtctccaggggaagagccaccctctcgtgcagggccagtcagagtgttagtagcaggcacttagcctggtatcagcagaaacctggccaggctcccaggcctcctcatctatggtgttctagcagggccagttggcatcccagacagattcagtgcagtgggtctgggacngacttcactctcaccatcaaacngactggagcctagaacgtattttgcggtctatttctgtcagctagtatgataccttgtaggtacgttcggaccaagggaccgaaggtaggaaaatacaaacgaaagtgtacggctggacaaccgatcgtacgtcttcactccttacccg

SEQ ID NO: 322153 - DNA, 560 bp, Homo sapiens
  misc_feature: GZ8MTXP02GQMC4.38.12.B01.1.454.CMB.2.raw
  modified_base (355)..(355): a, c, t, g, unknown or other
  misc_feature (355)..(355): n is a, c, g, or t
  modified_base (408)..(408): a, c, t, g, unknown or other
  misc_feature (408)..(408): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttatgacgcagtctccaggcaccctgtctttgtctccaggggaaggagccaccctctcgtgcagggccagtcagagtgttagagcaggcacttagcctggtatcagcagaacctggccaggctccaggctcctcatctatggtggttctagcagggcctagttggcatcccagacagattcaggtgcaggtgggtctggggacngacttcactctacacatcaaacagactggacgcctagaagtatttggcggttnttattcgtagtcagtctagtatgtattaccgttggtacggtacgttcggaccgaaggggaccaaagggtacggaaaactacgaaaacggtactggtacggactaggaccaacccgtagttcctcggttaccttactaccttcctttaccccg

SEQ ID NO: 322154 - DNA, 535 bp, Homo sapiens
  misc_feature: GZ8MTXP02IZRQH.38.12.B01.1.454.CMB.2.raw
  modified_base (207)..(207): a, c, t, g, unknown or other
  misc_feature (207)..(207): n is a, c, g, or t
  modified_base (287)..(287): a, c, t, g, unknown or other
  misc_feature (287)..(287): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaagagccaccctntcgtgcagggccagtcagagtgttagtagcaggcacttagcctggtatcagcagaacctggccaggctcccaggctcctnatctatggtggttctagcagggccagttggcatcccagacagattcagtgcagtgggtcngggacngacttcactctcacatcaacagactggacgcctagaagtattttgcggttctagtttctgtcagtctagtatgtataccgttgtggtacgttcggaccgtaagggaccaagggtacggaaaagtacgaaaacgacgtaggtacggactgacaaccgatctacgtctttacacttccttcccg

SEQ ID NO: 322155 - DNA, 521 bp, Homo sapiens
  misc_feature: GZ8MTXP02GFUSI.38.12.B01.1.454.CMB.2.raw
  modified_base (286)..(286): a, c, t, g, unknown or other
  misc_feature (286)..(286): n is a, c, g, or t
  modified_base (353)..(353): a, c, t, g, unknown or other
  misc_feature (353)..(353): n is a, c, g, or t
  modified_base (416)..(416): a, c, t, g, unknown or other
  misc_feature (416)..(416): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaagagccaccctctcgtgcagggccagtcagagtgttagtagcaggcacttagcctggtatcagcagaacctggccaggctcccaggctccncatctatggtggttctagcagggccattggcatcccagacagattcagtgcagtgggtctggggacngacttcactctcacatcaacagactgagcctgaagattttgcgtcttattctgtcagcagtangtataccgttgtgacgttcggacctaagggaccaaggtcggaaaactacaaaacgaacgtgtacggactgacaacgtatctagtcctttacacttccttaccccg

SEQ ID NO: 322156 - DNA, 574 bp, Homo sapiens
  misc_feature: GZ8MTXP02HDOQN.38.12.B01.1.454.CMB.2.raw
  modified_base (287)..(287): a, c, t, g, unknown or other
  misc_feature (287)..(287): n is a, c, g, or t
  modified_base (361)..(361): a, c, t, g, unknown or other
  misc_feature (361)..(361): n is a, c, g, or t
tcagtcgatcacgtcacgaccggtgctcgatttagtagtgtagatttcgcggggagagctgctcagttaggacccagagggaaccatggaaaccccagcgcagcttctcttcctcctgctactctggctcccagataccaccggagacattttatgacgcagtctccaggcaccctgtctttgctccgaggggaagagccaccctctcgtgcagggccagtcagagtgttagtagcaggcacttagcctggtatcagcagaaacctggccaggcctcccaggctccnatctatggtggttcagcagggcctagttggactatcccagaccagtattcgagtggctaggtgggtctgggacngtacttcactctcacatacaaacagactgacgcctagtaagtagttttgacggttacttacgtttcgtaggtcagtctagtattggaacttaccgttggtacggtacgtttacggacgtaaacgggaccaaagggtacgaaaattcgaaaacgtacgttaggtacggactacggaccaaccgtatccgttacgtcttacactttcctaccccg

SEQ ID NO: 322157 - DNA, 565 bp, Homo sapiens
  misc_feature: GZ8MTXP02I9XDW.38.12.B01.1.454.CMB.2.raw
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttatgacgcagtctccaggcaccctgtctttgtctccaggggaagagccacctctcgtgcagggccagtcagagtgttagtagcaggcacttagcctggtatcagcagaacctggccaggctcccaggctcctcatctatggtggttctagcagggccattggcatcccagacagnttcagtggcaggtggtctgggacnggtcttcacgtctcacatcaaacngactggacnctagaagtatttgcgttctattctagtcagctagtatgattaccttgtacggtacgtttacggaccgtaaaggggacccaaaggggtacggaaaacgtacgaaaacgtaaacgtggttacgggactacggactaacccgtatcccgttagttcctttacgtaactttacccgtttccccgg

SEQ ID NO: 322158 - DNA, 520 bp, Homo sapiens
  misc_feature: GZ8MTXP02HIA0F.38.12.B01.1.454.CMB.2.raw
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
tcagtcgatcacgtcacgaccggtgctcgatttagtagtgtagatttcgcggggagagctgctcagttaggacccagagggaaccatggaaaccccagcgcagcttctcttcctcctgctactctggctcccagataccaccggagacattttattgacgcagtctccaggcaccctgtctttgtctccgaggggaagagccacctctcgtgcagggccagtcagagtgttagtagcaggcacttagcctggtatcagcagaaacctggccaggctcccaggctcctcatctatggtggttcagcaggccagttggcatcccagacagattcagtggcaggtggtcngggacngacttcactctcacatcaacagactggacnctagagtatttgcgttntatttctgtacagctagtatagattcgttggtggtacgttcggaccaagggaccaaagggtacgaaaactcgaaaacgactggtacgctagacaacagtctacgtcttcactccgtcccg

SEQ ID NO: 322159 - DNA, 730 bp, Homo sapiens
  misc_feature: GZ8MTXP02JT4G8.38.12.B01.1.454.CMB.2.raw
  modified_base (288)..(288): a, c, t, g, unknown or other
  misc_feature (288)..(288): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttatgacgcagtctccaggcaccctgtctttgtctccaggggaaggacgccaccctctcgtgcagggccagtcagagtgttagtagcaggcacttagcctggtatcagcagaaacctggccaggctccaggctcctnatctatggtggttctagcagggccagttggcactcccagactagattcgaggttggcgtaggtgggtcgtaggggaactacggtacttcaaccgtctaccaacctacttaccaaaacgacggtaaccctaggggaacgtacccgttagaaaacggtttacgtttttcggaaccgggtttcctttaacgttttcgttacgggttaccaaagggtccgttaaaggtttactttacgggtaaacgtttaacccggtttgggtttaacgggggtaacccggttttacgggggaaccccgtaaaaacggggggtaaccctaaaagggggtttaacgggaaaaacttaccggaaaaaaccggtaaaccgttggggtacgggtaccttaggaaccctaacccggtattaccgttacggttcctttacgaacctttcccgtttaaccccg

SEQ ID NO: 322160 - DNA, 526 bp, Homo sapiens
  misc_feature: GZ8MTXP02G6ALP.38.12.B01.1.454.CMB.2.raw
  modified_base (207)..(207): a, c, t, g, unknown or other
  misc_feature (207)..(207): n is a, c, g, or t
  modified_base (287)..(287): a, c, t, g, unknown or other
  misc_feature (287)..(287): n is a, c, g, or t
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaagagccaccctntcgtgcagggccagtcagagtgttagtagcaggcacttagcctggtatcagcagaacctggccaggctcccaggctcctnatctatggtgttcagcaggccattggcatcccagacagacttcagtggcaggtgggtctggggacnggacttcactctcaacatcaaacngactggagcctgaagtattttgcggttctatttctgtcagcagtatgattaccgttggtcggtacgttcggaccgtaagggacaagggtacgaaaatacaaaacgaactggtagacctgaccaacgatctcgtacttcacttcttcccg

SEQ ID NO: 322161 - DNA, 533 bp, Homo sapiens
  misc_feature: GZ8MTXP02FOT4Q.38.12.B01.1.454.CMB.2.raw
  modified_base (291)..(291): a, c, t, g, unknown or other
  misc_feature (291)..(291): n is a, c, g, or t
  modified_base (356)..(356): a, c, t, g, unknown or other
  misc_feature (356)..(356): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagactattttattgacgcagtctccaggcaccctgtctttgtctccgaggggaagagccaccctctcgtgcagggccagtcagagtgttagtagcaggcacttagcctggtatcagcagaaacctggccaggcctcccagactcctnatctatgatgcatccacgaggccactggtcgtcccagccaggttcagtggctagtggctgggacngnttcacgtcncacntccagcagcctncagttcngaagtatttgactagtttattattgtacagtctagtatgatacgagtggcctcgatccgaccgttcggccgaaggggaccacggtacgtaacggaacaaaacgtaaaacgaacgtggtacgggaccttaggaccaccgtaacg

SEQ ID NO: 322162 - DNA, 535 bp, Homo sapiens
  misc_feature: GZ8MTXP02H7LQ4.38.12.B01.1.454.CMB.2.raw
  modified_base (198)..(198): a, c, t, g, unknown or other
  misc_feature (198)..(198): n is a, c, g, or t
  modified_base (288)..(288): a, c, t, g, unknown or other
  misc_feature (288)..(288): n is a, c, g, or t
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaagngccaccctctcgtgcagggccagtcagagtgttagtagcaggcacttagcctggtatcagcagaaacctggccaggctcccaggctcctnatctatggtggttctagcagggccattggcatcccagacagattcagtggcaggtgggtctggggacnggacttcacttctcacatcaacngactgagctgaatatttgcgttctattctgtcagctagtatgtattaccgttgtggtacggttcggacgtaaaggggaccgtaagggttaggaaactacgaaaacggtaacgtggtcggactcggacaacgactcgtgtcctactactccttcccg

SEQ ID NO: 322163 - DNA, 560 bp, Homo sapiens
  misc_feature: GZ8MTXP02F5UQG.38.12.B01.1.454.CMB.2.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (351)..(351): a, c, t, g, unknown or other
  misc_feature (351)..(351): n is a, c, g, or t
  modified_base (389)..(389): a, c, t, g, unknown or other
  misc_feature (389)..(389): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaagngccaccctntcgtgcagggccagtcagagtgttagtagcaggcacttagcctggtatcagcagaaacctggccaggctcccaggctcctcatctatggtgttctagcaggccattggcatcccagacagattcagtgcagtgggtctgggacngacttcactctcacatcaacagactgacgctagaagtntttgcgttcttattcgtgtcagtacagttatgtaattaccgttggtacggtacggtttacggaccgaaacggggtaccgtaaagggtaaggtaaaacgtacgaaaacggtaaacgttacggtaggtacgtgacaaccgtactacttcgttaccttctacttccttaccccg

SEQ ID NO: 322164 - DNA, 526 bp, Homo sapiens
  misc_feature: GZ8MTXP02G09SQ.38.12.B01.1.454.CMB.2.raw
  modified_base (286)..(286): a, c, t, g, unknown or other
  misc_feature (286)..(286): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (379)..(379): a, c, t, g, unknown or other
  misc_feature (379)..(379): n is a, c, g, or t
  modified_base (518)..(518): a, c, t, g, unknown or other
  misc_feature (518)..(518): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaagagccaccctctcgtgcagggccagtcagagtgttagtagcaggcacttagcctggtatcagcagaacctggccaggctcccaggctccnatctatggtgttctagcaggccattggcatcccagacagattcagtgcagtgggtctgggacngcttcacttcncacatcaacagactggacncctagaacgtatttggacgtctatttctagtcagtcagttatgtattaccgttggtcggtacgttcggacctaaggggacaagggtacgaaatacgaaaacgtagagtcggactggacaacgtactcgtactcttaccnctcctccg

SEQ ID NO: 322165 - DNA, 533 bp, Homo sapiens
  misc_feature: GZ8MTXP02IL0LY.38.12.B01.1.454.CMB.2.raw
  modified_base (287)..(287): a, c, t, g, unknown or other
  misc_feature (287)..(287): n is a, c, g, or t
  modified_base (349)..(349): a, c, t, g, unknown or other
  misc_feature (349)..(349): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttatgacgcagtctccaggcaccctgtctttgtctccgaggggaagagccaccctctcgtgcagggccagtcagagtgttagtagcaggcacttagcctggtatcagcaagaacctggccaggctcccagctcctnatctatggtgttcagcaggcagtggcatccagacagattcagtgcaggtgggtctagggacngtacttcactctacacatacaaacagactggancctagaagtnttttagcggttcttatttctgtacngactagtatgattacgttggtaggacgttcggaccgaaagggaccaaagggtacgaaaatacgaaaacgaacgtgtacggcttagacaacgtatctcgttactcacttcctacccg

SEQ ID NO: 322166 - DNA, 581 bp, Homo sapiens
  misc_feature: GZ8MTXP02J28EU.38.12.B01.1.454.CMB.2.raw
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (249)..(249): a, c, t, g, unknown or other
  misc_feature (249)..(249): n is a, c, g, or t
  modified_base (280)..(280): a, c, t, g, unknown or other
  misc_feature (280)..(280): n is a, c, g, or t
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagactatttttatgacgcagtctccaggcaccctgtctttgctcaggggaagnccacctntcgtgcagggccagtcagagtgtagagcaggcacttgcctggtancagcagaacctggccaggcctccaggcctcnatctagtggtgttcagcaggccagttcggcatcccagacagnttcgaggtgctaggtgggtcaggggacnggtacttcacttcaccaccatcccaacacgacgtggacgtccgtagaggttctttacggcggttactttgttctacggttcacggctagtatcggtaactttcgtgggtacggtacgttcgggacctaacggggaacgaaggtacggaaaactacggaaaacgtacgtggtacggacttacggacctaacgtacgttcctacggtttacctccgtaacctccgtttccccg

SEQ ID NO: 322167 - DNA, 623 bp, Homo sapiens
  misc_feature: GZ8MTXP02GWFNM.38.12.B01.1.454.CMB.2.raw
  modified_base (291)..(291): a, c, t, g, unknown or other
  misc_feature (291)..(291): n is a, c, g, or t
  modified_base (358)..(358): a, c, t, g, unknown or other
  misc_feature (358)..(358): n is a, c, g, or t
  modified_base (394)..(394): a, c, t, g, unknown or other
  misc_feature (394)..(394): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttatgacgcagtctccaggcaccctgtctttgtctccgaggggaagagcccaccctctcgtgcagggccagtcagagtgttagtagcaggcacttagcctggtatcagcagaaacctggaccaggcctccgaggcctccnatctatggtgttcagcaggccagttggcactcccagacagattcaggtgcaggtgggtctggggacngtactcactcctacaccatacaacagaccgtggacnccgtagaagtgttttcggacggttcttagttcgttagtacgtagtacgtagtattcggtaacttaccgtttggtacgggttaccggttacgggaacccggtaaaggggaacccgtaaaggggttaacggtaaaacgtaaccggtaaaaacgtacggttaggtacggtccgtaacggacctaaaccgttcgtactttacggtaccctttacaaccgtttcccctaccccg

SEQ ID NO: 322168 - DNA, 519 bp, Homo sapiens
  misc_feature: GZ8MTXP02JVP2D.38.12.B01.1.454.CMB.2.raw
  modified_base (352)..(352): a, c, t, g, unknown or other
  misc_feature (352)..(352): n is a, c, g, or t
  modified_base (463)..(463): a, c, t, g, unknown or other
  misc_feature (463)..(463): n is a, c, g, or t
tcagtcgatcacgtcacgaccggtgctcgatttagtagtgtagattccgcggggagagctgctcagttaggacccagagggaaccatggaagccccagcgcagcttctcttcctcctgctactctggctcccagtttcacaaaccactggagaagtagtgatgacgcagtctccagccaccctgtctgtgtctccaggggacagcgccaccctctcctgcagggccagtcacagtattaacaataacttagcctggtaccaacagcagactggccaggctccaggctcatcatgtatggttacagtccacagggccagtgtgtcccagcaggtcagagagcggtctgggacngagtcactctcacataacagtctgcagctagagtatttagctagtttagtactgtactagacaatatagactaccgtggacctcggtaacgttcggcgagtcgggaaccgnggtacggtaacgtacgaaaacgacgtagtaggaactagcacctatctcgttctacg

SEQ ID NO: 322169 - DNA, 503 bp, Homo sapiens
  misc_feature: GZ8MTXP02F8HOA.38.12.B01.1.454.CMB.2.raw
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaagagccaccctctcgtgcagggccagtcagagtgttagtagcaggcacttagcctggtatcagcagaaacctggccaggctcccaggctcctcatctatggtggttctagcagggccattggcatcccagacagatcagtgcagtggtctgggacngacttcactcncacatcaaangactganctgaatagttttgcggttctattctgtcagcagtatgtatactgtggcgttcggaccaagggactaaaggtgtaaaactcaaaacgtactgtggctgcaaccgatctacgttctcatccttccg

SEQ ID NO: 322170 - DNA, 563 bp, Homo sapiens
  misc_feature: GZ8MTXP02H95BD.38.12.B01.1.454.CMB.2.raw
  modified_base (290)..(290): a, c, t, g, unknown or other
  misc_feature (290)..(290): n is a, c, g, or t
  modified_base (438)..(438): a, c, t, g, unknown or other
  misc_feature (438)..(438): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttattgacgcagtctccaggcaccctgtctttgtctccaggggaaggagccaccctctcgtgcagggccagtcagagtgttagtagcaggcacttagcctggtatcagcagaaacctggccaggctcccaggcctcctnatctatggtgtttcagcagggccagttcggcatcccagaccagattcaggtggcaggtggggtctaggggacacgggtactttcgaaccttcctaccaacagttccaaactagactggacgcctagaagtatttgcggttctattctntcagctagtatgatacgttgtggtacgttcggacgaaacgggtaccgaagggtacgaaaagtcgaaaacgaactaggtacggactaggaccaacgtatacgttcgtcttactacttccttacccg

SEQ ID NO: 322171 - DNA, 588 bp, Homo sapiens
  misc_feature: GZ8MTXP02FTG2R.38.12.B01.1.454.CMB.2.raw
  modified_base (206)..(206): a, c, t, g, unknown or other
  misc_feature (206)..(206): n is a, c, g, or t
  modified_base (294)..(294): a, c, t, g, unknown or other
  misc_feature (294)..(294): n is a, c, g, or t
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
  modified_base (421)..(421): a, c, t, g, unknown or other
  misc_feature (421)..(421): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttatgacgcagtctccaggcaccctgtctttgtctccaggggaagagccaccctntcgtgcagggccagtcagagtgttagtagcaagggcacgttagccttgggtatcagcagaaacctggccaggctcccgaggcctcctnatctatggtgtctagcagggcctagttggctactcccgagacagtattcgaggtgcaggtgggtctaggggacngacttcactctaccacatcaaacngaactggacnccgtgaagtntttgcgttnttattctgtcagctagttatagtacttaccgttggtcggtacgtttcggaccgtaaacggggtacctaaagggtacgaaaacgttacgaaaacggtaaccgtggttaacggcgttaggacctaaccgtaacgttacgtcgttaccttctaactttccctttaccccg

SEQ ID NO: 322172 - DNA, 619 bp, Homo sapiens
  misc_feature: GZ8MTXP02FW35T.38.12.B01.1.454.CMB.2.raw
  modified_base (291)..(291): a, c, t, g, unknown or other
  misc_feature (291)..(291): n is a, c, g, or t
tcagtcgatcacgtcacgaccggtgctcgatttagtagtgtagattccgcggggagagctgctcagttaggacccagagggaaccatggaaaccccagcgcagcttctcttcctcctgctactctggctcccagataccaccggagacattttatgacgcagtctccaggcaccctgtctttgtctccgaggggaagacgccaccctctcgtgcagggccagtcagagtgtagtagcaggcacttagcctggtatcagacagaaacctggaccaggctcccgaggctcctnatctatggtgttcagcaggctagttggacatcccagacagtattcgagtgcaggtggtatggactggaccttcgacttccgaccaacgtactcaaacgagaccgtaggacgacgtagtaaacgtgtttttcggaccggttctttaacttcgttagtacgtaggtctaagttataggtacttaaccgttggttacgggtaccggtttacggaaccggtaaagggtacgtaaaacgggttacggaaaacttaccgaaaacgtaaccgtggtacgtaccgtcgaacctaacgtacgtttctcggttacctacgtacgtcccgtttaccccg

SEQ ID NO: 322173 - DNA, 541 bp, Homo sapiens
  misc_feature: GZ8MTXP01CB8V3.11.17.B06.1.454.CMB.2.raw
  modified_base (217)..(217): a, c, t, g, unknown or other
  misc_feature (217)..(217): n is a, c, g, or t
tcagcgagagataccacgaccggtgctcgatttagtcgatagtgaaggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccggnaagtcagatcattagcagctatttaaatggtatcagcagaaaccaggaaagcccctgagtcctgatctatgctgcatccagtttgcagagtcggggtcccatcgaaaggttcaaagttggcagtgggatctgcgacagtatttcactctcaccatcagcagtctgacaacgtagaaacgggtatttttgacctaaactttactacctagttacaaactcgtaagttaccaacgttacccccggtgggtaaccgttcgggacccgaaagggaacccgtaagggttacgggaaattacgaaacgactgtaggcttagcaacgtaac

SEQ ID NO: 322174 - DNA, 516 bp, Homo sapiens
  misc_feature: GZ8MTXP01D8POQ.11.17.B06.1.454.CMB.2.raw
  modified_base (218)..(218): a, c, t, g, unknown or other
  misc_feature (218)..(218): n is a, c, g, or t
  modified_base (269)..(269): a, c, t, g, unknown or other
  misc_feature (269)..(269): n is a, c, g, or t
  modified_base (374)..(374): a, c, t, g, unknown or other
  misc_feature (374)..(374): n is a, c, g, or t
tcagcgagagataccacgaccggtgctcgatttagtcgatagtgaaggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggnaaagtcagatcattagcagctattaaatggtatcagcagaaaccaggaaancccctgaggtcctgatctatgctgcatccagtttgcagagtcggggccatcaaggttcaagtgcagtggatctgcgacagatttcactctcaccatcagcagtcngcaactgaaggtattttgactaacttactactgtacaaacagtaagttacacgtaaccccggtggtaaccgttcgggaccgttaaagggaaccaaagggttacggaaattacgaaaacgactaagtggcttgccaacgtaac

SEQ ID NO: 322175 - DNA, 498 bp, Homo sapiens
  misc_feature: GZ8MTXP01D6D38.11.17.B06.1.454.CMB.2.raw
tcagcgagagataccacgaccggtgctcgatttagtcgatagtgaaggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccggcaagtcagatcattagcagctattaaattggtatcagcaagaaaccagggaaagcccctgaggtcctgatctatgctgcatccagtttgcagagtcgggtcccatcaagttcaagtgcagtggatctgcgacagattcactctcaccatcagcagtctgcaactgaaggtattttgactaacttactactgtacaaacagtagttacagtaccccgtggtacgttcggaccgttaaggaccaaggttaggaattacaaacgaactgtagcttgcaacgtaac

SEQ ID NO: 322176 - DNA, 515 bp, Homo sapiens
  misc_feature: GZ8MTXP01BJE37.11.17.B06.1.454.CMB.2.raw
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttggccgggcaagtcagatcattagcagctattaaatggtatcagacagaaaccaggaaacgcccctagaggtcctgatctatgctgcatccagtttgcagacgtcgggtccagtcaaggttcagtggcagtggatcgtgcgacagtattcactctcacatcagcagtctgacaacctgaaagtattttgactaaacttactactgtacaactagaagttaccgacgtaacccgtggacgttcggacgaaacgggtacgaagggttgaaacgtaacgaaaccgtaagtggtacggctcgctaacg

SEQ ID NO: 322177 - DNA, 577 bp, Homo sapiens
  misc_feature: GZ8MTXP01B7TZT.11.17.B06.1.454.CMB.2.raw
  modified_base (194)..(194): a, c, t, g, unknown or other
  misc_feature (194)..(194): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtagganacagagtcaccatcacttgccggcaagtcagatcattagcagctattaaatggtatcagcaagaaaccaggaaacgcccctgaggtcctgatctatgctgcatcctagtttgcagacgtggggtccagtcaaggttcagtgcagtggatctgcacagtatttcactctcaccatcagcagtctacgactaactagggtaaacgtttattttacaacttaacttactacttacgtaactaaactagtaacgttaaccgaccggttaaccccgtagggttaccggttaccggaaccggaaacggggtaaccgttaaagggttaacggttaaaacgtaaccgaaaacgtaacgttaggtacggttaccgttaacggaacctaaccg

SEQ ID NO: 322178 - DNA, 535 bp, Homo sapiens
  misc_feature: GZ8MTXP01AES2R.11.17.B06.1.454.CMB.2.raw
  modified_base (219)..(219): a, c, t, g, unknown or other
  misc_feature (219)..(219): n is a, c, g, or t
  modified_base (392)..(392): a, c, t, g, unknown or other
  misc_feature (392)..(392): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggnaagtcagatcattagcagtctatttaaattggatcagcaagaaaccaggaaacgcccctgaggtcctgatctatgctgcatccagtttgcagagtcgggtccagtcaaggttcaagtgcagtgatcgtgcgacagtatttcactctcaccatcagcagtctgcaactgaagtntttgactaaacttactactgtacaaactagtacgttacacggttaccccggtggtaacgttcgggaccgttaaacgggacctaaagggttagaaaacgttacgaaaaccggtaatcggtaggccttacggaaccaaccgtaag

SEQ ID NO: 322179 - DNA, 522 bp, Homo sapiens
  misc_feature: GZ8MTXP01D2YSN.11.17.B06.1.454.CMB.2.raw
  modified_base (271)..(271): a, c, t, g, unknown or other
  misc_feature (271)..(271): n is a, c, g, or t
tcagcgagagataccacgaccggtgctcgatttagtcgatagtgaaggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccggcaagtcagatcattagcagctattaaatggtatcagacaagaaaccagggaaacncccctagacggtcctgatctatgctgcatcctagtttgcaggacggtcggggtacccagtcgaaaggttcaggtggcagtggatcgtagcgacagtatttcactctcaccatcagcagtctgacactgggaatattttgactaacttactactgtacaactagtattaacgcgtaacccgtggaccgttcggaccgaaagggaccaaagggttggaaaactaacgaaagaactggtaggctcggctaaccg

SEQ ID NO: 322180 - DNA, 520 bp, Homo sapiens
  misc_feature: GZ8MTXP01E3R3X.11.17.B06.1.454.CMB.2.raw
  modified_base (194)..(194): a, c, t, g, unknown or other
  misc_feature (194)..(194): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtagganacagagtcaccatcacttgccgggcaagtcagatcattagcagctattaaattggatcagcaagaaaccaggaaacgcccctgacggtcctgatctatgctgcatccagttgcagagtcgggtccatcaagtcaagtgcagtgatctgcgacagtactttcactctcaccatcagcagtctgacaactgaagtatttgactaacttactactgtacaaactagtacgttaacacgtaccccggtggtaaccgttcgggaccgttaaacgggaccaagggttaggaaaacttacgaaaacgacgtggtcggcttacgcgaaccgtaa

SEQ ID NO: 322181 - DNA, 544 bp, Homo sapiens
  misc_feature: GZ8MTXP01CXI5O.11.17.B06.1.454.CMB.2.raw
  modified_base (219)..(219): a, c, t, g, unknown or other
  misc_feature (219)..(219): n is a, c, g, or t
  modified_base (267)..(267): a, c, t, g, unknown or other
  misc_feature (267)..(267): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggnaagtcagatcattagcagctattaatgtatcagcagaaaccaggaaancccctgagtcctgatctatgctgcatccagtttgcaggtacggtcggggtaccagtacgaaggttcagtggctaggtgatcgtgcgacagtattcactctacaccatcagcagtctagacaactggaagtattttcgactaacttactactgtacaaactagtaacgttaccgaacgttaaccccggtaggttaccggttacggaccgaaaggggtacccgaaagggttacggaaaactaacgaaaacgtaacgtggtacggacctcggcgtaaccg

SEQ ID NO: 322182 - DNA, 496 bp, Homo sapiens
  misc_feature: GZ8MTXP01EVAOA.11.17.B06.1.454.CMB.2.raw
  modified_base (219)..(219): a, c, t, g, unknown or other
  misc_feature (219)..(219): n is a, c, g, or t
  modified_base (474)..(474): a, c, t, g, unknown or other
  misc_feature (474)..(474): n is a, c, g, or t
  modified_base (486)..(486): a, c, t, g, unknown or other
  misc_feature (486)..(486): n is a, c, g, or t
tcagcgagagataccacgaccggtgctcgatttagtcgatagtgaaggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtccaccatcacttgccgggnaagtcagatcattagcagctattaaatggtatcagcagaaaccagggaaagcccctgaggtcctgatctatgctgcatccagtttgcagacgtgggggtccagtcaaggttcagtggcagtggatcgtgcgacagatttcactctcacaatcagcagtctgcaacctggaagtattttgctaaacttactactgtacaactagtagttacagtaaccccgtggacgttcggcgaagggtaaccaggttgaataanaaacgaactagnggactgcaac

SEQ ID NO: 322183 - DNA, 577 bp, Homo sapiens
  misc_feature: GZ8MTXP01CYSQQ.11.17.B06.1.454.CMB.2.raw
  modified_base (194)..(194): a, c, t, g, unknown or other
  misc_feature (194)..(194): n is a, c, g, or t
  modified_base (277)..(277): a, c, t, g, unknown or other
  misc_feature (277)..(277): n is a, c, g, or t
  modified_base (417)..(417): a, c, t, g, unknown or other
  misc_feature (417)..(417): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctcctgtctgcatctgtagganacagagtcaccatcacttgccgggcaagtcagatcattagcagcttatttaaatggtatcagacaagaaaccgaagggaaacnccccgtagacggtcctagacttctatgctgcattcctagtttgacaggtacggtcggggtacctagtaccgaaggttacaggtggcgtaaggtggtactcgtgacgacagtactttcactctacaccatacagcagttcngaccaactaggtaacgttatttacgacttaaacttactactagtacaacgtagtacgtactacggtaacccggtaggttaccggttacggaccgtaaacgggaaccgaaggttacggaaaactaaccgaaaacggaacttggacgctaacgaactaaccg

SEQ ID NO: 322184 - DNA, 557 bp, Homo sapiens
  misc_feature: GZ8MTXP01EQ5PA.11.17.B06.1.454.CMB.2.raw
  modified_base (219)..(219): a, c, t, g, unknown or other
  misc_feature (219)..(219): n is a, c, g, or t
  modified_base (273)..(273): a, c, t, g, unknown or other
  misc_feature (273)..(273): n is a, c, g, or t
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggnaagtcagatcattagcagctatttaaatggtatcagcaagaaaccagggaaacncccctgagtcctgatctatgctgctatcctagtttgcagacggtcggggtcccagtcgaaggttcaaaggttgcgtaggtgatcgtgcgacagtactttcactctcaccatcancagtcngacaactgtaagtattttgactaacttactactgtacaaactgtaacgttactaccggttaccccgtggtaaccgttcgggaccgttaaacgggaaccgtaagggttacgaaagttaaccgaaacgacgttaacggtcggacgttacgaaccgttaacgtaacg

SEQ ID NO: 322185 - DNA, 493 bp, Homo sapiens
  misc_feature: GZ8MTXP01D1ZR9.11.17.B06.1.454.CMB.2.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (270)..(270): a, c, t, g, unknown or other
  misc_feature (270)..(270): n is a, c, g, or t
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
  modified_base (431)..(431): a, c, t, g, unknown or other
  misc_feature (431)..(431): n is a, c, g, or t
  modified_base (483)..(483): a, c, t, g, unknown or other
  misc_feature (483)..(483): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgtagganacagagtcaccatcacttgccggnaagtcagatcattagcagctatttaaatggtatcagacagaaacaggaaancccctgaggtcctgatctatgctgcatccagtttgcagtacggtggggtccagtcgtaaggttacagtggcagtggatctgcgacagtatttcactctcaccatcagcancngacaactgggaactatttgactaacttctactgtacaactagtattacncgtaaccgtgacgttcggacgaagggacaaggttgaaatcaaaacgtctggngctgctaacc

SEQ ID NO: 322186 - DNA, 494 bp, Homo sapiens
  misc_feature: GZ8MTXP01D5UTD.11.17.B06.1.454.CMB.2.raw
  modified_base (193)..(193): a, c, t, g, unknown or other
  misc_feature (193)..(193): n is a, c, g, or t
  modified_base (268)..(268): a, c, t, g, unknown or other
  misc_feature (268)..(268): n is a, c, g, or t
  modified_base (425)..(425): a, c, t, g, unknown or other
  misc_feature (425)..(425): n is a, c, g, or t
  modified_base (483)..(483): a, c, t, g, unknown or other
  misc_feature (483)..(483): n is a, c, g, or t
tcagcgagagataccacgaccggtgctcgatttagtcgatagtgaaggggcaggagtcagtctcagtcaggacacagcatggacatgagggtccccgctcagctcctggggctcctgctactctggctccgaggtgccagatgtgacatccagatgacccagtctccgtcctccctgtctgcatctgtagganacagagtcaccatcacttgccggcaagtcagatcattagcagctattaaatgtatcagacagaaaccaggaaacncccctgaggtcctgatctatgctgcatcctagtttgcagagtcggggtccatcaaggttcagtggcagtgatctgcgacagtattcactctcaccatcagcagctgacaacctggaaagtattttgactaacttactactgtacaaactagattacncgtaaccccgtggttaccgttcggcaaagggaccaaggttgaaataacaaagaactgnggctcgcaacc

SEQ ID NO: 322187 - DNA, 623 bp, Homo sapiens
  misc_feature: GZ8MTXP01D2OQA.11.17.B06.1.454.CMB.2.raw
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagcttaatttaaattggtatcagacaagaaaccgagggaaacgcccctgaggtcctgatctatgctgctatcctagtttgcgaggacggttcggggtaccccagtaccgtaaaggtttccgaaagggttcgggcgtagggtgggacttcgtaggcgtaacgtagtacttttcaacttctacaacctatacagctaagtctacgactaacgtagtaagttacttttagaacctaactttacctacgtacgtaacaaacgtacgtaacgttaaccgacggttaccccggtaaggtacccgttacgggaccgttaaacggggaaccgtaagggttacgaaacttaaccgaaaacgtaacgtggtacggcttacgaaccttaaccgttaacg

SEQ ID NO: 322188 - DNA, 521 bp, Homo sapiens
  misc_feature: GZ8MTXP01CKT3O.11.17.B06.1.454.CMB.2.raw
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (349)..(349): a, c, t, g, unknown or other
  misc_feature (349)..(349): n is a, c, g, or t
  modified_base (412)..(412): a, c, t, g, unknown or other
  misc_feature (412)..(412): n is a, c, g, or t
  modified_base (509)..(509): a, c, t, g, unknown or other
  misc_feature (509)..(509): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctattaaatgtatcagcagaaacaggaaancccngagtctgatctatgctgcatcctagtttcgcagtacgtggggtaccagtcaaaggttcaagtggctaagtggactcgngtacgactagtactttcactctacaccatcagtcagtctgacaaccttgggaaattactttanactaacttactactagtacaactagtacgtacgacgtaaccgtggttacgtacggaaccgaaacgggtacaaaggagaaactaacaaacgtaagtgngctcgaactaac

SEQ ID NO: 322189 - DNA, 546 bp, Homo sapiens
  misc_feature: GZ8MTXP01BEGYA.11.17.B06.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtagganacagagtcaccatcacttgccgggnaagtcagatcattagcagctattaaatgtatcagcaagaaaccagggaaacncccctgacggtcctgatctatgctgcatccagtttgcagcggtcggggtccagtcgaaggttcaggtggcaggtggatctgcgacagtatttcactctcacatcagccagtctcgactaaccgtggtaaagttattttacgacttaaacttactactgtaccaaacgtagtacgttaaccacgtaaccccggtggttaccggttcgggaccgtaaacgggtaccaaagggttcggaaaactaaccgaaacgaacgtggtggacgtcgcgtaaccg

SEQ ID NO: 322190 - DNA, 522 bp, Homo sapiens
  misc_feature: GZ8MTXP01EDHPR.11.17.B06.1.454.CMB.2.raw
  modified_base (272)..(272): a, c, t, g, unknown or other
  misc_feature (272)..(272): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgtagagacagagtcaccatcacttgccggcaagtcagatcattagcagctatttaaatggtatcagcaagaaaccagggaaacncccctagacggtcctgatctatgctgcatccagtttgcaggtacgtcggggtccagtcaaggttcagtgcagtgatctgcacagatttcactctcacatcagcagtactgactaaccgtaggtaaagtatttttacgactaaacttactatgtaacactagtattacgacgtaacccgtggaccgttacggaccgaaagggaaccaaaggttcggaaaataacgaaaacgaattggaggctcgctaaccg

SEQ ID NO: 322191 - DNA, 578 bp, Homo sapiens
  misc_feature: GZ8MTXP01D793L.11.17.B06.1.454.CMB.2.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
  modified_base (278)..(278): a, c, t, g, unknown or other
  misc_feature (278)..(278): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgtagganacagagtcaccatcacttggccgggnaagtcagatcattagcagctatttaaatgtatcagacaagaaaaccgagggaaaacnccccgtagacggtcctagatctatgctgcatcctagttgcaggacggtcggggtaccagtacgaaggttacagtggctaaggtggatcgtgacgtacagtattacactctcacatcagcatctagacaacctggggtaaattattttacgacctaaacttactactacgtaacaactagtacgttaacgaccggtaaccccggtggttaccggttccgaaccggaaacgggtaaccgttaaagggttacgaaaactaaccgaaaacgtaacgtacggtcgggttactggaacccgtaacc

SEQ ID NO: 322192 - DNA, 678 bp, Homo sapiens
  misc_feature: GZ8MTXP01CKOUZ.11.17.B06.1.454.CMB.2.raw
  modified_base (220)..(220): a, c, t, g, unknown or other
  misc_feature (220)..(220): n is a, c, g, or t
  modified_base (281)..(281): a, c, t, g, unknown or other
  misc_feature (281)..(281): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctcctgtctgcatctgtaggagacagagtcaccatcacttcgccggganaagtcagatcattagcagtacttaatttaaatggtatacagacaagaaaccgagggaaacnccccgtagacggtcctagatctatcgctgactactaccgtagtttgacgtaggtacggtcggggtacctaagttaccgtaaacgggtttaccagggttcggacgtaaagggttgggtactcgtcggacgtaactagttactttaccgacttccctacctaacctattaccgaacgtctagtcctacggacctaaccttaggggtaaacgtttatttttacgaaccttaaactttacctaacgtacgtaaccaaacgtaacgtaacgtttaaccgaccgggttaaccccggtagggttaccggtttaccgggaaccggtaaacggggaacccttaaaggggttcgaaaacgtaaccgtaaaacggtaacgtagggtcggttactaacgaactaacccg

SEQ ID NO: 322193 - DNA, 561 bp, Homo sapiens
  misc_feature: GZ8MTXP01BTT56.11.17.B06.1.454.CMB.2.raw
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctattaatggtatcagacaagaaaccagggaaacgcccctaggacggtcctgactctatgctgcatcctagtttgcaggtacggtcggggtccagtcgaggttacagtggcaggtggatcgtgcgacagtattcactctacacatcagtcagtctagactaacctggaaattgtttcacttaaacttctactagtaacaactagtacgttaccgtaacggtaaccccggtaggttaccggttaccggaccgtaaacggggaacccaaagggttacggaaaattaaccgaaacggtaacgtaggtcggcttaacgaacctaaccg

SEQ ID NO: 322194 - DNA, 620 bp, Homo sapiens
  misc_feature: GZ8MTXP01CAAYH.11.17.B06.1.454.CMB.2.raw
  modified_base (283)..(283): a, c, t, g, unknown or other
  misc_feature (283)..(283): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
tcagcgagagataccacgaccggtgctcgatttagtcgatagtgaagggggcaggagtcagtctcagtcaggacacagcatggacatgagggtccccgctcagcctcccggggctcctgctactctggctccgaggtgccagatgtgacatccagatgacccagtctccgtcctccctgtctgcatcgtgtaggagacagatcacatcacttgccggacaagtcagatcattagctagtacttaatttaaatggtatcaagacgaaagaaaccgagggaaccnccctaggacgtccngatctatgctnactatcctagtttgacgtaggacggttccgggtacccataccgtaagttcgaagtgcaaggtgactctaggacgacagtactttcacctctaccaacataccaggtactacgtctacgactaaccgtagtaaggttaacttttcgaaaccttaacttacctacgtactacaaaccgtagtaccgttaacaccggttacccggtaaggtaaccggttaccgggaaccgaaacgggtaaaccgtaaggttacggaaaaacttaaacccgtaaagggtaaccgtaaggtcggtacacggtaaccgaaacctttcg

SEQ ID NO: 322195 - DNA, 647 bp, Homo sapiens
  misc_feature: GZ8MTXP01A2E06.11.17.B06.1.454.CMB.2.raw
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtcctccgtcctccctgtctgcatctgtaggagacagagtcaccatcacttgccgggcaagtcagatcattagcagacttaatttaaattggtatcagacaagaaaccgaggaacgcccctaggacgtcctgatctatcgctgctatccgagtttgcgtaggacggtccggggtacccagttccgtaaaggttcgaaaggttcgggctagggtgggatcgtggacgactagtacttcactctaccactatacagtcacgttcacgtaccaaaccgttagaaacggtttacgttttacgaaccttaaactttactaacgttacgtaactaaacgtacgttaaacgttaccgtaaccggttaccccggtaaggtaccggtttaccgggaaccgttaaacggggtaaaccgtaaagggttaaacgggttaaaacttaccggtaaaaaccgtcgttaacggtcggaccttacggaacccttaactaacg

SEQ ID NO: 322196 - DNA, 708 bp, Homo sapiens
  misc_feature: GZ8MTXP01ANG9E.11.17.B06.1.454.CMB.2.raw
  modified_base (195)..(195): a, c, t, g, unknown or other
  misc_feature (195)..(195): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgtagganacagagtcaccatcacttgccggacaagtcagatcattagcagtctatttaatggtatcagacaagaaaccaggaaacgcccctagacggtcctgatctatgctgctatcctagtttgcgtaggacgtcggggtacctagtacgtaaggttcagtggacgtaggtcggatcgtagacgtactagttactttcacctcctacaccctagtccagtcctacggttcctacgacctaaccgttagggtaaaggtttacttttacggaaccctttaaacctttaacctaccgtttacgtaaccgtaaactacgggttaaccggttaaaccgtaacccggggttaaccccccgggttagggggttaaaccccggtttaccccggggaaaccggtaaacccgggggtaaacccggttaaaacggggttaacgggttaaaaaccgttaacccggtaaaacccggtaaccggtttacggggtacgggttacccgttaaccgggttaaccccttaaccccgg

SEQ ID NO: 322197 - DNA, 525 bp, Homo sapiens
  misc_feature: GZ8MTXP01CY3YD.11.17.B06.1.454.CMB.2.raw
  modified_base (195)..(195): a, c, t, g, unknown or other
  misc_feature (195)..(195): n is a, c, g, or t
  modified_base (270)..(270): a, c, t, g, unknown or other
  misc_feature (270)..(270): n is a, c, g, or t
  modified_base (404)..(404): a, c, t, g, unknown or other
  misc_feature (404)..(404): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgtagganacagagtcaccatcacttgccggcaagtcagatcattagcagctattaaatggtatcagcagaaaccaggaaacncccctgaggtcctgatctatgctgcatccagtttgcaggacgtcggggtccagtccgaaggttcagtggacaggtggatctgcgactagtatttcactctacacatcagcagtctgactaaccgtggtaacgtnttttacgactaacttactactgtacaactagtacttacgacgtaaccccgtggttacgttcggaccgaaacgggccaaagggttcgaaaatcgaaaacgtaacgtggtcgactcgctaacc

SEQ ID NO: 322198 - DNA, 502 bp, Homo sapiens
  misc_feature: GZ8MTXP01B8LRO.11.17.B06.1.454.CMB.2.raw
  modified_base (220)..(220): a, c, t, g, unknown or other
  misc_feature (220)..(220): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgtaggagacagagtcaccatcacttgccgggnaagtcagatcattagcagctattaaatggtatcagcagaaaccaggaaagcccctgaggtcctgatctatgctgcatccagtttgcagacgtggggtccatcaaggttcagtggcagtgatctgcgacagtatttcactctcacatcagcagtctgactaaccgtgaagtattttgactaacttactactgtacaactagtagttaccagtaaccccgtggaccgttcggcgtaaacgggaccaaggttgaaactaacaaacgaacgtgcggctcgctaacc

SEQ ID NO: 322199 - DNA, 596 bp, Homo sapiens
  misc_feature: GZ8MTXP01DEMMH.11.17.B06.1.454.CMB.2.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatcgtgtagganacagatcaccatcacttgccggnaagtcagatcattagcagtctaattaatgtatcagacaagaaacaggaaacncccctagacgtcctgatctatgctgcacttccgtagtttgcgtaggtcggtcggggtaccagtaccgtaaggttcgaagggttgggtacgtgggaatcgtgacgaatagtactttcaccttctacaccatacacggtctacgttcacgactaaaccgttagtaaacggtttacttttacgacttaaactttactacttagtaccaaagagtacgttaccgaccggttaccccgtggtaaccggttacgggacccgaaagggtaacccgtaagggttaagaaacgttaccgaaacgtaacgtcggtaggccttgaaccttcgtaac

SEQ ID NO: 322200 - DNA, 638 bp, Homo sapiens
  misc_feature: GZ8MTXP01EBFKS.11.17.B06.1.454.CMB.2.raw
  modified_base (195)..(195): a, c, t, g, unknown or other
  misc_feature (195)..(195): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgtagganacagagtcaccatcacttggccgggcaagtcagatcattagcagtcttaatttaaatggtatcagacaagaaaccgagggaaactcccctgacggttcctgactctatgctgactacgtcctagtttcgactaggtaccggtcgggtaccagttaccgtaaggttcaaggttggactaggtcggatcgtggacgtactagtctttcactctacacgtatcagctagtctagaactaccgttaggggtaaacgtttgttttacaaccttaaactttacctagttacgttaaccaaacgtaggttaaccgttaaccgaccggttaaccccggttgggttaccggtttaccgggaacggaaacggggtaaccgttaaggggttaacgttaaacgttaaccggaaaaacgttccgtaggggtacgccggttaacgaaccgttaaccg

SEQ ID NO: 322201 - DNA, 607 bp, Homo sapiens
  misc_feature: GZ8MTXP01EB74D.11.17.B06.1.454.CMB.2.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (480)..(480): a, c, t, g, unknown or other
  misc_feature (480)..(480): n is a, c, g, or t
tcagcgagagataccacgaccggtgctcgatttagtcgatagtgaagggggcaggagtcagtctcagtcaggacacagcatggacatgagggtccccgctcagcctcccggggctcctgctactctggctccgaggtgccagatgtgacatccagatgacccagtctccgtcctccctgtctgcatctggtagganacagagtcaccatcacttggccgggnaagtcagatcattagctagtcttaatttaaatggtatcagacaagaaaccgagggaaacgcccctgacggtcctagatctatgctgctatccgtagtttcgacgtaggtacggttccggggtaccctaagtacgtaaagggtttcaaagggttggcgtaggtgggacttcgtaggacgacgtagtactttcactctacactatacagctagttcacgactaacgtgtaaggttatttacgaacttaacttactacgtntaacaaacgtagtaacgttaccgaccggttaccccggtgggtaaccgttcgggaaccgaaagggtaaccgtaaaggttagaaacttacgaaacggtactggtcggacttcgtaaccttaacgttaac

SEQ ID NO: 322202 - DNA, 647 bp, Homo sapiens
  misc_feature: GZ8MTXP01A4YIT.11.17.B06.1.454.CMB.2.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtcctccgtcctccctgtctgcatctgtagganacagatcaccatcacgttggccgganaagtcagtatcaattagctagtacttaatttaaagttggtatacgagacaaacgaaaccgagggaaaccgccccgtaggacgtcctagtatctatgctgctacttccgtagtttcgacgtaggtacggtcccggggtaccctagtacgtaaacggttcgaaaggttggcgtagggtcggtactcgtacggacgtaacgtacgttactttcacctctaccacctagtacacgtactacggtctacgaacctaacgttagtaacgttatttcgaaccttaacttactacgttacgtaactaaacgtacgtaacgttaccgtaccggtaccccggtaaggtccggttacggaaccgttaagggaaaccgtaagggttaacgttaacttaacgaaacggtatcgggtacggacttacggcttaaccgttc

SEQ ID NO: 322203 - DNA, 601 bp, Homo sapiens
  misc_feature: GZ8MTXP01DTKQK.11.17.B06.1.454.CMB.2.raw
  modified_base (218)..(218): a, c, t, g, unknown or other
  misc_feature (218)..(218): n is a, c, g, or t
  modified_base (271)..(271): a, c, t, g, unknown or other
  misc_feature (271)..(271): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccggnaagtcagatcatagcagtctaattaatggtatcagacagaaaccgaggaaacncccctgacggtctgatctatgctgcatcctagtttgacgtaggtacggtcggggtaccagttacgtaaaggtttcaggttgggctagggttgggactcgtggacgactagtacttttcacttcacctacgattcgagctagtctagacaacgttaggtaagtttatttacacttaaacttacctacgttacgactaaacgtagtacttacgaaccggtaaccccggttggttaacccggttcggaacgaaacgggtacccgttaaagggttcggttaaaaactaacgaaaaacggtcgttacgggcggttaaccttcggaacccgttaac

SEQ ID NO: 322204 - DNA, 644 bp, Homo sapiens
  misc_feature: GZ8MTXP01A128K.11.17.B06.1.454.CMB.2.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatcgacccagtcctccgtcctccctgtctgcatctggtaggagacagagtcaccatccacttcggccgganaagtcagatcattagcagtnttaatttaaatggtatacgagacaagaaaccgagggaaacgccccgtaggacgtcctgatctatgctgctactcctagtttcgacgaggtacggtcggggtacctagtacgtaacggttacgagggttcggacgtagggttacggagttcgtacgcgtaacgtacgttacttacctactacctaccactactacgagacctacggttaccttacggacctaaacccgttagggtaaacgtttagttttaccgaacctttaaaccgttacttactacgtaaccaaacgtagtaaccgttacgaaccgttccccggtagttaccggttaccggaccgtaaacgggaacgaaaggttacgaaagtaaccgaaaacgtcgtacggtcggactcgccgtaaccg

SEQ ID NO: 322205 - DNA, 525 bp, Homo sapiens
  misc_feature: GZ8MTXP01BUJIU.11.17.B06.1.454.CMB.2.raw
  modified_base (218)..(218): a, c, t, g, unknown or other
  misc_feature (218)..(218): n is a, c, g, or t
  modified_base (509)..(509): a, c, t, g, unknown or other
  misc_feature (509)..(509): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctcctgtctgcatctgtaggagacagagtcaccatcacttgccgggnaagtcagatcattagcagctattaaatggtatcagcaagaaaccagggaaacgcccctgaggtcctgatctatgctgctatccagtttgctaggtacggtcggggtaccagtcgtaaaggttcagtggcagtgggatcgtgcgactagtatttcactctcaccatcagcagtctagacaaccgtaggtaagttacttttgacctaacttactactagtacaataggtattaccgacggtaacccgtggttacgtcggttacgaagggaccaaggttggaaataacgaaacncgtgaggctgctaacc

SEQ ID NO: 322206 - DNA, 641 bp, Homo sapiens
  misc_feature: GZ8MTXP01ASIZX.11.17.B06.1.454.CMB.2.raw
  modified_base (194)..(194): a, c, t, g, unknown or other
  misc_feature (194)..(194): n is a, c, g, or t
  modified_base (273)..(273): a, c, t, g, unknown or other
  misc_feature (273)..(273): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtagganacagagtcaccatcacttgccgggcaagtcagatcattagcagctatttaaatggtatcagcaagaaaccagggaaacncccctgacggtcctgatctatgctgcatcctaagtttcgctaaggtcgtcggggtacctagtacctaaggttacggagtgacgtagtagtacgtcgtacgtactactacttacttactacctacctacctactactactacgtacgtacgtacgtacgtaaccgtaacgtacggtaacgttacgtttacgtaaccttaacttaacttacgttacgtaacgtaacgtaacgtaacgttaccgtaaccggttaacccggtacggttaccggtaccggttaaccggtaaaccgggtaacggttaaacggttaacggttaaacgtaaaccgtaaacgtaacgtacggtacgttacgtaaccgaaccgtaacg

SEQ ID NO: 322207 - DNA, 689 bp, Homo sapiens
  misc_feature: GZ8MTXP01AFDZW.11.17.B06.1.454.CMB.2.raw
  modified_base (193)..(193): a, c, t, g, unknown or other
  misc_feature (193)..(193): n is a, c, g, or t
  modified_base (275)..(275): a, c, t, g, unknown or other
  misc_feature (275)..(275): n is a, c, g, or t
  modified_base (689)..(689): a, c, t, g, unknown or other
  misc_feature (689)..(689): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctcctgtctgcatctgtagganacagagtcacatcactggccggcaagtcagatcattagcagtacttaatttaaatggtatcagacaagaaaccgagggaacnccccgtagacggtcctgtatctatgctgcatccgtagtttcgacgtaggacggttcccgggggtaccccaagttacgtaaacgggtttcgaaagggttcgggctaagggtcggtacttccgtaggaccgtacgtacgttactttaccacttcctaccaaccctattaccgagtccctaagtcccgtacgtacctaaaccgttaggtaaacgtttacttttacggaacctttaaaccgtttacttaaccttagtaaccgtaaacgtaagttaccggttaacccgtaccgggttaacccccgggtaagggtaacccggtttaccggggaacccggaaaggggtacccgtaaaggggttacggttaaaacgttaccgtaaacggtacgttggtacgggcttacggaaccaaccgttn

SEQ ID NO: 322208 - DNA, 669 bp, Homo sapiens
  misc_feature: GZ8MTXP01ADA1F.11.17.B06.1.454.CMB.2.raw
  modified_base (194)..(194): a, c, t, g, unknown or other
  misc_feature (194)..(194): n is a, c, g, or t
  modified_base (279)..(279): a, c, t, g, unknown or other
  misc_feature (279)..(279): n is a, c, g, or t
tcagcgagagataccacgaccggtgctcgatttagtcgatagtgaagggggcaggagtcagtctcagtcaggacacagaatggacatgagggtccccgctcagctcctggggctcctgctactctggctccgaggtgccagatgtgacatccagatgacccagtctccgtcctccctgtctgcatctgtagganacagagtcaccatcacttggccggacaagtcagatcattagcagtcttaatttaaatggtatcagacaagaaaccgagggaaacnccccgtagacggtcctagtatctatgctgacatccgtagtttgacaggtacggtccgggtacccagtacgtaaaggtcaaggttggcgtaggtcgggtatcgtaggacgacagtactttcactctacactatacgagctacgtctacgaacctaaccgtaggtaaactttacgttttacgaaccttaaaccgtttaccaacttacgaacctaaaccgtaggttaaccgttaaccgtacccgggttaaccccggtaacgggtaaccggtttacccggggaaacccgaaaacgggggtaaaccgtaaagggggttaaccggaaaaacgttaaccgaaaaaccgggtaacgttcggggtacgggtaccttacggtaacccgaacgtttaaccg

SEQ ID NO: 322209 - DNA, 754 bp, Homo sapiens
  misc_feature: GZ8MTXP01DOD4N.11.17.B06.1.454.CMB.2.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (273)..(273): a, c, t, g, unknown or other
  misc_feature (273)..(273): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgtaganacagatcacatcacttgccgganaagtcagatcattagcagtctaatttaaatggtatcagacaagaaacgaggaaacncccctagacggtcctgattctatgctgcacttccgtagtttcgacgtacggtacggtccggggtacctagtaccgtaaaggggttaccaagggttcggactagggttacgggtaacgttcgttacggacgtaacgtacggttaacttttaccgtaaacctccgtttaccaaaccccgttaaattcccgtaaacgacccgtaacggtttacccgtacggtaaaccttaaaccccgtttagggggttaaaaaaccggtttactttttttaaccggaacctttaaaacccgtttaaccgttaacttacccggtttaaaacgtaaaccgttaacgttaaaccgttaacccgtaacccgggttaacccggtacgggttaccggttaccgggaaaccggtaaacgggtaaccggttaaacgggttaacggttaaaacgtaaccggtaaaacgtaacgttacggtacgttaccgtaacgaacgtaacg

SEQ ID NO: 322210 - DNA, 568 bp, Homo sapiens
  misc_feature: GZ8MTXP01B4NBF.11.17.B06.1.454.CMB.2.raw
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
  modified_base (399)..(399): a, c, t, g, unknown or other
  misc_feature (399)..(399): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggnaagtcagatcattagcagctatttaaattggatcagcaagaaaccaggaacncccctgaggtcctgatctatgctgcatccagtttgcagagtccgggtccatcgaagttcaagtggaagtgatctgcgacagtatttcactcctacactatcaagcagtctagacctaactgaaagttnttttaggactaacttaccttactcgtacaactaacgtagttaaccgaacgttaccccggtggtaaacccggttccgggaaacgtaaacgggaacccgtaaagggtacggttaaaaacgttccgaaaacgtaacgtagtcgggtacctacggcctaaccccaaggtttcc

SEQ ID NO: 322211 - DNA, 723 bp, Homo sapiens
  misc_feature: GZ8MTXP01AJYYG.11.17.B06.1.454.CMB.2.raw
  modified_base (196)..(196): a, c, t, g, unknown or other
  misc_feature (196)..(196): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatcgacccagtcctccgtcctccctgtctgcatctgtagganacagacgtcaccatcacttcggaccgggcaagtcagtatacattacgctagtacttaatttaaagtggtaactacgaagaccaaacggaaaaccgaacggggaaaccgtcccccgtagggtacgggttaccctaggtaacttctagtcgctacgactacgttaccgtaggtttcgacgtacgggtacggttccggggtacctagtacgtaaggttcgaggtggcgtaggtggactcgtcggactactagttactttccacttacctaccaactactacgacgtacgtacgtctacgacctaaccgtaggttaaagtttacgtttaccgaacctttaacttaccgacttacgtaaccctaaaggtaccgttaaccgttaccggtacccggttaacccgggttcgggttaacccgggtttaaccgggaacccgggtaaacggggtaaaccgttaacgggggtttaaacgaaaccgttaaacccggtaacggtaaccgttgggaccggttaccgtcgttaaccctaaccg

SEQ ID NO: 322212 - DNA, 509 bp, Homo sapiens
  misc_feature: GZ8MTXP02IJPIQ.11.17.B06.1.454.CMB.2.raw
  modified_base (307)..(307): a, c, t, g, unknown or other
  misc_feature (307)..(307): n is a, c, g, or t
tcagcgagagataccacgaccggtgctcgatttagtcgatagtgaaggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcaagaaaccagggaaagcccctgaggtcctgatctatgctgcatccagtttncagagtggggtcccatcaaggttcagtggcagtggatctgcgacagattcactctcaccatcagcagtctgcaacctgaaagtattttgcaaactttactaactgtacaaacagacgtttacagttaaccccgtggtacgttcggaccaaacgggacccaaagggtgaaaagtcgaaaacgaacgtgtggacgtgacaaccg

SEQ ID NO: 322213 - DNA, 497 bp, Homo sapiens
  misc_feature: GZ8MTXP02FZIHV.11.17.B06.1.454.CMB.2.raw
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctattaaatgtatcagcagaaaccaggaaacgcccctgagtcctgatctatgctgcatccagtttgcagagtggggtcccatcaaggttcagtgcagtggatctgcgacagtatttcactctcaccatcagcagtctagcaacctgaaagtattttgactaacttactactgtacaacagtattacacgtaccccgtggtacgttcggaccgaaagggaccaaggtaggaatacgaaacgaactgtacggctcgacacca

SEQ ID NO: 322214 - DNA, 501 bp, Homo sapiens
  misc_feature: GZ8MTXP02FT2HZ.11.17.B06.1.454.CMB.2.raw
  modified_base (440)..(440): a, c, t, g, unknown or other
  misc_feature (440)..(440): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaatggtatcagcagaaaccagggaaagcccctgaggtcctgatctatgctgcatccagtttgcagagtggggtcccatcaaggttcagtggcagtgatctgcgacagatttcactctcaccatcagcagtctgacaaacctgaaacgatttttgactaaactttactactgtacaacagagttacacgtaccccgnggtacgttcggacaaagggaccaaggtgaaaatcgaaaacgaactgtagctacgactaacc

SEQ ID NO: 322215 - DNA, 614 bp, Homo sapiens
  misc_feature: GZ8MTXP02IVVYP.11.17.B06.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctcctgtctgcatctgtagganacagagtcaccatcacttggccggnaagtcagatcattagcagtcttaatttaaattggtatcagacaagaaaccgagggaaacgcccctagacggtcctgatctatgctgcatcctagtttgcgaggtacggtcggggtaccctatacgtaaggttcgaggtgggcaggtgatcgtgacgacagtattccccccccccctatcctacaaccactacacgactacgtacgtacgactaacctagtaagttatttacgtactaaccttacttacttacgtactaactaacgtaacgtaacgtacgttacccggtacgggtaaccggttaccggtaaccggtaaacgggtaaccgtaaacgggtaacggtaaacgtaaacgtaaaacgtaaacgttacggtacggtacgtacgacgtaaccg

SEQ ID NO: 322216 - DNA, 537 bp, Homo sapiens
  misc_feature: GZ8MTXP02JMESP.11.17.B06.1.454.CMB.2.raw
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctattaaattggtatcagcagaaaccagggaaagcccctgaggtcctgatctatgctgcatccagtttgcagagtggggtccatcaaggttcagtggcagtggatctgcgacagatttcactctcaccatcagcagtctgcaacctgaagtattttgctaaactttactactgttacaaacagtaacgtttacacggttacccccgtggtaaccggtttaccggaccgaaaacggtacccgaaagggtacggaaaataaccgaaaacgtaaacgtcggtaggacttacggactaaacccg

SEQ ID NO: 322217 - DNA, 680 bp, Homo sapiens
  misc_feature: GZ8MTXP02I8U5G.11.17.B06.1.454.CMB.2.raw
  modified_base (196)..(196): a, c, t, g, unknown or other
  misc_feature (196)..(196): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatcgacccagtcctccgtcctccctgtctgcatctgtagganacagagtcaccatcacgttggccggacaagtcagatcaattagacagtacttaatttaaagtggtaatcgagacaaacgaaaaccgaagggaaacctccccgtaggacgtcctagactctatgctgctactcctagtttcgcgaggtacggtccggggtaccctagtcgtaaaggttcaggtcgcgtaggtggatcgtcgacgacgtagtactttaccactccctacaacctactacgacgtactacgtcgtacgacctaaaccgtaggtaaactttacgttttacgaaccctttaaaccgtttaaccttacgttacgtaactaaacggtaagttaaccggtttaacgaacccggttaccccggttacgggtacccggttaccgggaaacccggtaaaaggggtacccgtaaaaggggtaaacgtaaaccgttaaacgaaaaccggtagtacgggttacggacctacggacccctaacgtaccg

SEQ ID NO: 322218 - DNA, 723 bp, Homo sapiens
  misc_feature: GZ8MTXP02F6371.11.17.B06.1.454.CMB.2.raw
  modified_base (219)..(219): a, c, t, g, unknown or other
  misc_feature (219)..(219): n is a, c, g, or t
  modified_base (276)..(276): a, c, t, g, unknown or other
  misc_feature (276)..(276): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgtaggagacagagtcaccatcacttgccggnaagtcagatcattagcagtacttaatttaatggtatcagacaagaaaccaggaaacncccctagacggtcctgatctatgactgacacttccgtagtttcgacgtaggtaccggttaccggggtaccctagtaccggtaagggtttaccgaagggttgggacgtagggttggtaccttcgtaggaccgtaactagttacttttaccaccttcctaccaaccttaactaccgtagtaccgtacgttaccgtacgtaaaccgttaaacgttaaggttaaacgtttactttacgtaaacctttaaaacctttaccgttaacgttaacgtaaaccgtaaacgttaacgttaaccgtttaacccggtaacccggttaaccccgggttacggttaacccgggtaaccgggaaacccggtaaaacggggtaaaccggtaaaaggttaaaccgtaaaacgtaaccggtaaacggttaacggtacggtacggtaccgtaccgaacccgtaacg

SEQ ID NO: 322219 - DNA, 539 bp, Homo sapiens
  misc_feature: GZ8MTXP02JLUSQ.11.17.B06.1.454.CMB.2.raw
  modified_base (353)..(353): a, c, t, g, unknown or other
  misc_feature (353)..(353): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctaatttaaattggtatcagcagaaaccagggaaacgcccctgacgtcctgatctatgctgcatcctagtttgcaggagtcggggtcccatcgaaggttcagtggcagtggatcgngcgacagtacttcactctacaccatcagcagtctacgacaaaccgtgtaaagtattttagacttaactttaactactagtacaacagtacgttaacgacgtacccgtcggtacgttccggaccgaaagggacccgaaagggtacgaaatacgaaaacgtaactaggtacggactcgaccacgtaac

SEQ ID NO: 322220 - DNA, 498 bp, Homo sapiens
  misc_feature: GZ8MTXP02JNXKR.11.17.B06.1.454.CMB.2.raw
tcagcgagagataccacgaccggtgctcgatttagtcgatagtgaaggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccaggaaagcccctgaggtcctgatctatgctgcatccagtttgcagagtcggggtcccatcaaggttcaggtgcagtggatctgcgacagatttcactctcaccatcagcagtctgcaacctgaaagtattttgactaacttactactgtacaacagtagttacagtaccccgtggacgttcggacgaacggaccaaggtacgaaactacgaacgaactgtacggctcgacactac

SEQ ID NO: 322221 - DNA, 516 bp, Homo sapiens
  misc_feature: GZ8MTXP02IFZOH.11.17.B06.1.454.CMB.2.raw
  modified_base (219)..(219): a, c, t, g, unknown or other
  misc_feature (219)..(219): n is a, c, g, or t
  modified_base (273)..(273): a, c, t, g, unknown or other
  misc_feature (273)..(273): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggnaagtcagatcattagcagctatttaaattggtatcagcagaaaccagggaaacncccctgaggtcctgatctatgctgcatccagtttgcagagtcggggtcccatcaagttcagtgcagtggatctgcgacagatttcactctcaccatcagcagtctgcaaacctgaaatattttgactaacttactacgtgtacaaacagtagtttacacgttaccccgtaggtacgttccggacaaaacggggaccaacggttaggaaacacgaaaacgtaaactggtaggactcgacaactc

SEQ ID NO: 322222 - DNA, 594 bp, Homo sapiens
  misc_feature: GZ8MTXP02HPPW1.11.17.B06.1.454.CMB.2.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (280)..(280): a, c, t, g, unknown or other
  misc_feature (280)..(280): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtcctgcatctgtagganacagatcacatcacttggccgganaagtcagatcattagcagacttaatttaaattggtatcagacaagaaaccgaagggaaccnccccgtaggacggtcctgattctatgctgactacttccgtagtttcgacgaggtacggtccccggggtaccctagttacgtaaacggtttcaaggttcggcgaggttggtatcgtagacgaatagtactttcacttctacactatcagctagtctacgacctaaacgtagtaatttattttcgaacttaacttactactagtaccaatagtaacttacgaacgtacccgtagtaccggttcggaaccgtaaacgggaacctaagggtaacgaaactaacgaaacgtacgtagtacggactacgacctaacgtac

SEQ ID NO: 322223 - DNA, 666 bp, Homo sapiens
  misc_feature: GZ8MTXP02JLK5Z.11.17.B06.1.454.CMB.2.raw
  modified_base (219)..(219): a, c, t, g, unknown or other
  misc_feature (219)..(219): n is a, c, g, or t
  modified_base (287)..(287): a, c, t, g, unknown or other
  misc_feature (287)..(287): n is a, c, g, or t
  modified_base (436)..(436): a, c, t, g, unknown or other
  misc_feature (436)..(436): n is a, c, g, or t
tcagcgagagataccacgaccggtgctcgatttagtcgatagtgaagggggcaggagtcagtctcagtcaggacacagcatggacatggagggtccccgctcagctcctggggctcctgctactctggctccgaggtgccagatgtgacatccagatgacccagtctccgtcctcctgtctgcatctgtaggagacagagtcaccatcactggccgganaagtcagatcattagcagtacttaatttaaagttggtatacagacaaacgaaaccggaagggaaaccnccccgtaggacggtcctagacttctatgctgctactccgtagtttcgacgtaggtaccgggtccggggtaccctagttaccggtaaaggtttccaagggttcgggacgtaagggttggtactcgtaggacgaacgtagttactttaccncctactacaaccctataccaagcctagtcacgacctaacgtagaagtttactttacgaccttaaacttacgtactacgtaactaaactacggtaacgtttaaccgacccggttacccggtagggtaaccggttacccggaaaccggaaacgggtaaccgtaaagggttaacggaaaactaaccggtaaaaaccgtacgttagggacgttaccgtacgaacccgttaaccg

SEQ ID NO: 322224 - DNA, 523 bp, Homo sapiens
  misc_feature: GZ8MTXP02FOXO4.11.17.B06.1.454.CMB.2.raw
  modified_base (219)..(219): a, c, t, g, unknown or other
  misc_feature (219)..(219): n is a, c, g, or t
  modified_base (269)..(269): a, c, t, g, unknown or other
  misc_feature (269)..(269): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggnaagtcagatcatagcagctatttaaatgtatcagcagaaaccagggaaancccctgaggtcctgatctatgctgcatccagtttgcagacgtggggtcccatcaaggttcagtggcagtggatcgtgcgacagtatttccatctacacatccagcagtctgacaaactgaaagtattttcgactaaacttactactagtacaaacagtaacgttacacgtacccgtaggtaccgttacggaccgaaacgggtaaccgaaaggtaggaaaactaacgaaaacgaactaggtacgacacgacaacc

SEQ ID NO: 322225 - DNA, 608 bp, Homo sapiens
  misc_feature: GZ8MTXP02HYK76.11.17.B06.1.454.CMB.2.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
tcagcgagagataccacgaccggtgctcgatttagtcgatagtgaagggggcaggagtcagtctcagtcaggacacagcatggacatgagggtccccgctcagcctcccggggctcctgctactctggctccgaggtgccagatgtgacatccagatgacccagtctccgtcctccctgtctgcatctgtagganacagagtcaccatcacttggccgggnaagtcagatcattagcagacttaattaaattaggtatacagacaagaaaccgaagggaaacgaccccgtagacggtcctgggggggatctatgctgcactcctagtttgtacgaggtaggtccggggtccgtacgtacgtaaggttacgtaggtggcgtaggtggtagtcgtgtacgactagtattactactctacaccactcagcacgtctacgacaacgtagtaagttatttagtactaacttactacttacgtactaacgacgtaacgttacgtacgttacccggtacggtaccggttaccgggaccggtaaacgggaaccggtaacggtaacggtaaacgtaacgaaaacgtaacgtacggtacggtacgtacgactactacg

SEQ ID NO: 322226 - DNA, 537 bp, Homo sapiens
  misc_feature: GZ8MTXP02G1EMM.11.17.B06.1.454.CMB.2.raw
  modified_base (270)..(270): a, c, t, g, unknown or other
  misc_feature (270)..(270): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctattaaattggtatcagcagaaaccaggaaanccctgaggtcctgatctatgctgcatccagtttgcagagtcggggtcccagtacaaggttcaagtggcagtggatctgcgacagatttcactctcacctatcagcagtctgactaaccgtgaaagtattttgactaaacttactactagttacaaactagtacgtaacacggttacccgtggtacgttccggaccgtaaacgggacccaaagggtacggaaaataaccgaaaacggaaccgttaggtacggactacggactaacccg

SEQ ID NO: 322227 - DNA, 534 bp, Homo sapiens
  misc_feature: GZ8MTXP02GY16G.11.17.B06.1.454.CMB.2.raw
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagacgtggggtcccatcaaggttcagtggcaggtggatctgcgacagtatttcactctcaccatcagcagtctgaccaaccgtgaacgttatttacgactaaacttactactgtacaaacagtagttacacgttacccgtgggtaccgttccggaccgaaacgggacccgaaagggtacggaaaactaacgaaaacgtaacgtaggtacggactacgacctaaccg

SEQ ID NO: 322228 - DNA, 519 bp, Homo sapiens
  misc_feature: GZ8MTXP02GSPWL.11.17.B06.1.454.CMB.2.raw
  modified_base (194)..(194): a, c, t, g, unknown or other
  misc_feature (194)..(194): n is a, c, g, or t
  modified_base (270)..(270): a, c, t, g, unknown or other
  misc_feature (270)..(270): n is a, c, g, or t
  modified_base (389)..(389): a, c, t, g, unknown or other
  misc_feature (389)..(389): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtagganacagagtcaccatcacttgccggcaagtcagatcattagcagctattaaattggtatcagcagaaaccaggaaacncccctgagtcctgatctatgctgcatccagttgcagagtcggggtccatcaaggttcagtgcagtggatcgtgcgacagtatttcactctacacatcagcagtctgacaactgaaattntttagactaacttacacttgtacaacgtagtagttacacgttaaccccgtggtaccgttcggaccgaaagggaccgaaagggtacgaaaactacgaaaacgtaacgtaggtacgactacgaccaactacg

SEQ ID NO: 322229 - DNA, 564 bp, Homo sapiens
  misc_feature: GZ8MTXP02JDRB0.11.17.B06.1.454.CMB.2.raw
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttggccgggcaagtcagatcattagcagcttattaaattggtatcagcaagaaaccgaggaaacgccccgtagacggtcctgatctatgctgctatcctagtttgacgtaggacggtcggggtacccagtacgaaggttcaggtggcaggtggatcgtgacgactagtatttcactctacacctatccagcagtctagactaactagtaagttatttacgacttaacttactactagtacaaacgtagtaacgttacacggttaccccgtggtaccggttacggaccgtaaagggaccgtaaagggtacgaaaacgtaacgaaaacgtacgtaggtacgacgtacgactaaccg

SEQ ID NO: 322230 - DNA, 546 bp, Homo sapiens
  misc_feature: GZ8MTXP02JTDP4.11.17.B06.1.454.CMB.2.raw
  modified_base (421)..(421): a, c, t, g, unknown or other
  misc_feature (421)..(421): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagtctaatttaatggtatcagacaagaaaccgagggaaacgcccctagacggtcctgatctatgctgctatcctagtttcgacgtaggtacggtcggggtcccagtacgtaaggttcaggtggcaggtggatcgtgacgacagtacttcactcacacatcagcagtcagacctaactgtaacgttntttacgacttaacttactactagtacaatagtacgttacgaccgtacccggtaggtaccgtcggaaccgaacgggaccaaaggtacgaaactaacgaaacgtacgtcggacgtctacgactaacg

SEQ ID NO: 322231 - DNA, 568 bp, Homo sapiens
  misc_feature: GZ8MTXP02IE1WZ.11.17.B06.1.454.CMB.2.raw
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgtaggagacagagtcaccatcacttgccggcaagtcagatcattagcagtctatttaaattggtatcagcaagaaaccagggaaacgcccctgacggtcctgatctatgctgcatctagttgcagagtcggggtccagtcaaggttcagtgggcaggtggatcgtgacgactagtattcactctacactatcagcagtctcgacaaaccgttgaacgttattttacgactaaactttactacttagtacaaacgtagtagttaaccgtaacggttaccccggttagggtaccggttacgggacccgtaaacgggtaccgaaaaggttaggaaaactaacgaaaacgtaaccgttaggtacggaccttacgacctaaaccg

SEQ ID NO: 322232 - DNA, 557 bp, Homo sapiens
  misc_feature: GZ8MTXP02HSYWN.11.17.B06.1.454.CMB.2.raw
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgctagacgtggggtccccataccgaaggttcagtgggcagtggatcgtgcgacagtatttcactctcacccatcagcagtctcacctacctagaagttatttacgactaaccttactactagtacaactagtaacgtacgtaccggttacccgtagggttaccggttaccggaaccggtaaacgggaaccgtaaagggtaacggaaaactaacgaaaacgaacgttacggacggtactacggacctaaccg

SEQ ID NO: 322233 - DNA, 525 bp, Homo sapiens
  misc_feature: GZ8MTXP02IZ3QI.11.17.B06.1.454.CMB.2.raw
  modified_base (376)..(376): a, c, t, g, unknown or other
  misc_feature (376)..(376): n is a, c, g, or t
  modified_base (393)..(393): a, c, t, g, unknown or other
  misc_feature (393)..(393): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtccatcaaggttcagtggcaggtgatctgcgacagatttcactctcacatcagcagtcngacaaccttagaacgtntttacgctaacttactacttgtacaaacagtattacacgttacccgtggtaccgttcggaccgaaacgggacctaaagggtacggaaaataaccgaaaacgtaacgtacggtacggtacgtacggactaacc

SEQ ID NO: 322234 - DNA, 510 bp, Homo sapiens
  misc_feature: GZ8MTXP02GCOZL.11.17.B06.1.454.CMB.2.raw
  modified_base (194)..(194): a, c, t, g, unknown or other
  misc_feature (194)..(194): n is a, c, g, or t
  modified_base (384)..(384): a, c, t, g, unknown or other
  misc_feature (384)..(384): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtagganacagagtcaccatcacttgccgggcaagtcagatcattagcagctattaaattggtatcagcagaaaccaggaaagcccctgaggtcctgatctatgctgcatccagtttgcagagtggggtcccatcaaggttcagtggcagtggatctgcgacagatttcactctcaccatcagcagtctgcaacctnaagtatttgactaacttactactgtacaaacagtagttacacgtacccgtaggtacgttcggaccgaaacgggacccgaaaggttaggaaaactaacgaaaacgaacgtggtaggctacgcaaacc

SEQ ID NO: 322235 - DNA, 541 bp, Homo sapiens
  misc_feature: GZ8MTXP02HZGY4.11.17.B06.1.454.CMB.2.raw
  modified_base (220)..(220): a, c, t, g, unknown or other
  misc_feature (220)..(220): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgtaggagacagagtcaccatcacttgccgggnaagtcagatcattagcagctattaaattggtatcagcagaaaccagggaaagcccctgacggtcctagatctatgctgcatccagtttgcagagtggggtcccatcaaggttcagtggcagtgatctgcacagtatttcactctacaccatcagctagtctgacctaacctagtaaagttattttagactaacttactaactagttacaaacagtacgttaacacgttacccggtaggtaccggttaccggaccgaaacgggaccgaacggttaacggaaaacgtaaccgaaaacggtacgtaggagtctacgtaccaacg

SEQ ID NO: 322236 - DNA, 537 bp, Homo sapiens
  misc_feature: GZ8MTXP02HBBNI.11.17.B06.1.454.CMB.2.raw
  modified_base (350)..(350): a, c, t, g, unknown or other
  misc_feature (350)..(350): n is a, c, g, or t
tcagcgagagataccacgaccggtgctcgatttagtcgatagtgaaggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcaagaaaccagggaaagcccctgaggtcctgatctatgctgcatccagtttgcagagtggggtccatcaaggttcagtggcagtgatctgcgaanatattcactcacacatcagacagtactcgacaactagtaagttattatactaacttaactactactactaacaagtaacgtacgtaacgtaaccgtacggtacggtaccggtaccggaaacggaacgtaaacggtaacggtaaacgtaaacgtaaaacgtaaacgtacgtacggtacgtacgtacac

SEQ ID NO: 322237 - DNA, 582 bp, Homo sapiens
  misc_feature: GZ8MTXP02HI9R7.11.17.B06.1.454.CMB.2.raw
  modified_base (276)..(276): a, c, t, g, unknown or other
  misc_feature (276)..(276): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtcctccgtcctccctgtctgcatctgtaggagacagatcaccatcacttgccggcaagtcagatcattagcagcttaatttaaatggtatcagacaagaaaccgagggaaacnccccgtagacggtcctagatctatgctgcactccgtagtttcgacgtaggtaggtccggggtaccccagtacgtaaaggtttcaggttgggcgtaggtaggatcgtgacgaacgtagtactttccaccttactacacctatacagctacgtctacgacctaacgtagtaagttacttttacgaacttaacttactactagtaacaacgtagtactacgtacgtacccgtaggtaccgtacggaccgaaacgggacgaaaggtacgaaaacgtacgaaacgtacgtaggtcgacgtacgactactag

SEQ ID NO: 322238 - DNA, 516 bp, Homo sapiens
  misc_feature: GZ8MTXP02IQ7DS.11.17.B06.1.454.CMB.2.raw
  modified_base (219)..(219): a, c, t, g, unknown or other
  misc_feature (219)..(219): n is a, c, g, or t
  modified_base (355)..(355): a, c, t, g, unknown or other
  misc_feature (355)..(355): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggnaagtcagatcattagcagctattaaattggtatcagcagaaaccaggaaacgcccctgaggtcctgatctatgctgcatccagtttgcagacgtggggtcccagtctaaggttcagtggcaggtggatcgtgcganagtatttcactctacacatcagcagtctcgactaacctgaagttatttcgactaacttactactagtacaatagtagtacgacgtaccgtaggtacgtacgaccgaacgggaccaaggtacgaaactaacgaaaacgacgtacggacgtactacgactaac

SEQ ID NO: 322239 - DNA, 562 bp, Homo sapiens
  misc_feature: GZ8MTXP02IRO51.11.17.B06.1.454.CMB.2.raw
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggacaagtcagatcattagcagcttaatttaaattggtatcagcaagaaaccagggaacgcccctggacgtcctgatctatgctgcatcctagtttgcgaggtaggtccggggtcccctatacgtaaggttcgaggttggcgagtggatcgtgcgactagtacttcactctacacatacagcacgtctcgactaaccgtagtaaatacttttagacttaacttactaacgtatacaacgtaagtacgttactacggtaccccggtaggtaccgttaccggaccggaaacgggacgtaacggtaacgaaacttaacgaaacgtaacgtggtacgctacgacactacg

SEQ ID NO: 322240 - DNA, 505 bp, Homo sapiens
  misc_feature: GZ8MTXP02JW7C2.11.17.B06.1.454.CMB.2.raw
  modified_base (267)..(267): a, c, t, g, unknown or other
  misc_feature (267)..(267): n is a, c, g, or t
  modified_base (388)..(388): a, c, t, g, unknown or other
  misc_feature (388)..(388): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctattaatggtatcagcagaaacaggaaancccctgagtcctgatctatgctgcatccagtttgcaggacgtggggtccatcaaggttcagtggcagtggatctgcgacagtatttcactctcaaccatcagcagtctgacactgtaagtnttttgactaacttactacttcgtacaatagtagttacacggtacccgtcggtacgttcggacgaaacggaccgaaggtaggaaactaacgaaaactacgtagtggactcggacaacc

SEQ ID NO: 322241 - DNA, 541 bp, Homo sapiens
  misc_feature: GZ8MTXP02GS9XR.11.17.B06.1.454.CMB.2.raw
  modified_base (219)..(219): a, c, t, g, unknown or other
  misc_feature (219)..(219): n is a, c, g, or t
  modified_base (437)..(437): a, c, t, g, unknown or other
  misc_feature (437)..(437): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggnaagtcagatcattagcagctatttaaattggtatcagcaagaaaccagggaaacgcccctgacggtcctgatctatgctgcatccagtttgactagacgtcggggtccagtcgtaaggttcaggtggcaggtggatcgtgcgacagtatttccactctacacatcagcagtctgacaactagtaagtatttacgactaacttactactgtactaaacngtaacgttacacggtacccgtggtaccgttcggaccgaagggtaccaagggtacggaaaactaacgaaaacggtaactggtacggtacctacggtactaacccg

SEQ ID NO: 322242 - DNA, 788 bp, Homo sapiens
  misc_feature: GZ8MTXP02GCFAZ.11.17.B06.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (270)..(270): a, c, t, g, unknown or other
  misc_feature (270)..(270): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtagganacagagtcaccatcacttgccgggnaagtcagatcatagcagctattaatgtatcagcaagaaaccgagggaaacncccctggacgtcctagatctatgctgcatcctagtttgacgtaggacggttcggggtccccaagtaccgtaaaggtttccaagggttcggggaccgtagggttagggtaacgttccgttacgggaccgtaaaccgtaaagggtttaacctttttaccccgtaacctttaccccgttaacccgaaaccccgtaacttaccccggaaacgggccccttaaacgggtttcccgttaaacggaccccgttaaaaacccgttaggggtaaaacttttaacgttttttacgggaaaccctttaaaacccgtttttaaccgtaaacctttaaccggttaacctaaaacgtaaacggggttaaacgtttaaacccggaacccggtttaaccccggggttagggtaaaccccgggtttaccggggaaacccgaaaaccgggggtaaacccgtaaaggggtaacggaaaaaccgttaaccgaaaaacggtaacgttacgggttcgaccgtacggttaccctaaacccg

SEQ ID NO: 322243 - DNA, 522 bp, Homo sapiens
  misc_feature: GZ8MTXP02GOS3X.11.17.B06.1.454.CMB.2.raw
  modified_base (220)..(220): a, c, t, g, unknown or other
  misc_feature (220)..(220): n is a, c, g, or t
  modified_base (357)..(357): a, c, t, g, unknown or other
  misc_feature (357)..(357): n is a, c, g, or t
  modified_base (494)..(494): a, c, t, g, unknown or other
  misc_feature (494)..(494): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgtaggagacagagtcaccatcacttgccgggnaagtcagatcattagcagtcttattaaatgtatcagacagaaaccaggaaacgcccctgaggtcctgatctatgctgcatccagttgcgtagacggtcgggtccagtcgaaggttcagtgcaggtgatcgtagcganagtatttcactctactaaccatcgagtctagtctacgaccaacgtagaagtttatttacgactaaccgttactacgtcgtacaactagtacgtacacggtacccgtggacctcggacgacgggacgaacgtagaaanaacgaaacgactcggtagctgacctacg

SEQ ID NO: 322244 - DNA, 527 bp, Homo sapiens
  misc_feature: GZ8MTXP02F1X39.11.17.B06.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (268)..(268): a, c, t, g, unknown or other
  misc_feature (268)..(268): n is a, c, g, or t
  modified_base (399)..(399): a, c, t, g, unknown or other
  misc_feature (399)..(399): n is a, c, g, or t
  modified_base (429)..(429): a, c, t, g, unknown or other
  misc_feature (429)..(429): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtagganacagagtcaccatcacttgccgggnaagtcagatcattagcagctattaaatgtatcagcaagaaacaggaaancccctagagtcctgatctatgctgcatccagtttgacagacgtggggtacccatcgaagtcagtggcagtggatctagcgacagtatttccacttcacacctatccagcagtctcgacaactagaacgttntttacgactaacttactacttgtaccaaanagtaacgttacacggtacccgtaggtaccgttcggaccgaaagggaccgtaaaggtcggaaactaacgaaaactaacgtcggtagtacgtcgactacg

SEQ ID NO: 322245 - DNA, 658 bp, Homo sapiens
  misc_feature: GZ8MTXP02JKAFY.11.17.B06.1.454.CMB.2.raw
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagtcttaatttaaattggtatcagacaagaaaccgagggaaacgccccgtagacggtcctagatctatgctgcatcctagtttgacgtagacggtcgggtacccagtcgaaggttcaggtcggctaaggtcggtatcgtaggacgaacgtacgtactttccacttctaccaacctatccgaagtctacgtactacggacctaaccgttagtaaacgtttacgttttacgactttaaacctttaccgtaacttacgttaacgaaacgtacgttaaacgttaaccgtaaccggttaaccccgggttagggtaaccggtttaccgggaaaccggtaaacggggtaacccgtaaaacggggtacggtaaaaacgtaacggaaaaaccggtaacgttacggggtacgtacgtacggaccgttaaaccg

SEQ ID NO: 322246 - DNA, 530 bp, Homo sapiens
  misc_feature: GZ8MTXP02F2NEK.11.17.B06.1.454.CMB.2.raw
  modified_base (354)..(354): a, c, t, g, unknown or other
  misc_feature (354)..(354): n is a, c, g, or t
  modified_base (378)..(378): a, c, t, g, unknown or other
  misc_feature (378)..(378): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaatggtatcagcagaaaccaggaaagcccctgaggtcctgatctatgctgcatccagtttgcagacgtggggtcccatcaaggttcagtggcagtggatcgtgcgacagntttcactctcaccatcagcagtcngacaaccgtgaagtattttgactaaactttactattactacaaacgagtaacgttacgaacgttaccccgtaggtaccgttcggaccgaaacgggacccgaaaggtacgaaaactaacgaaaacgtacgttacggaggactacggactaacg

SEQ ID NO: 322247 - DNA, 614 bp, Homo sapiens
  misc_feature: GZ8MTXP02IY3SO.11.17.B06.1.454.CMB.2.raw
  modified_base (219)..(219): a, c, t, g, unknown or other
  misc_feature (219)..(219): n is a, c, g, or t
  modified_base (278)..(278): a, c, t, g, unknown or other
  misc_feature (278)..(278): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggnaagtcagatcattagcagcttaatttaaattggtatcagacaagaaaccgagggaaacnccccgtagaggtcctgatctatgtctgcatcctagtttgacaggacgtcgggaccctagtacgaaggttcaggtggactagtggatcgtagacgacagtacttacactctacaccatcagtcacgtctcgacctaaaccgtagaaacgtttagtttacgaacttaaacctttaacctactacgtaacgtaaacgtagttaaccgtttaacaacccgggttaaccccggttagggtacccggttaccggaaaccggtaaacggggtaaccctaaaaggggtacgtaaaacgtaaccgaaaacgtaaacgtcgggtaaggtacctacggacctaaccg

SEQ ID NO: 322248 - DNA, 584 bp, Homo sapiens
  misc_feature: GZ8MTXP02H08SU.11.17.B06.1.454.CMB.2.raw
  modified_base (268)..(268): a, c, t, g, unknown or other
  misc_feature (268)..(268): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctcctgtctgcatctgtagagacagagtcacatcacttgccggcaagtcagatcattagcagctattaaattgtatcagcaagaaaccaggaaacnccccgtgaggtcctgatctatgctgcatcctagtttgcaggtacggtggggtacccatcgtaaggttcagttggcaggtggatcgtgacgacagtatttcactctacaacctatccagtcaagtctgactaacctgtaaattgttttacacttaaacttacctactagttaccaaaactagtaacgttaacgaacggttaaccccggtagggtaacccgttcgggaaacccgtaaaacggggtaacccgaaaaggggttaacgaaaacgtaacgaaaacggtaaacgtacggttaggaccttacggaccgtaaccg

SEQ ID NO: 322249 - DNA, 600 bp, Homo sapiens
  misc_feature: GZ8MTXP02GNCJ1.11.17.B06.1.454.CMB.2.raw
  modified_base (275)..(275): a, c, t, g, unknown or other
  misc_feature (275)..(275): n is a, c, g, or t
  modified_base (411)..(411): a, c, t, g, unknown or other
  misc_feature (411)..(411): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttggccggcaagtcagatcattagcagtctaatttaaatggtatcagacaagaaacagggaaacnccccgtgagtcctgatctatgctgcatcctagttgacaggtacggtcggggtaccctagtaccgtaaggttcaaggttcgggactaggtggtatcgtgacgactagtactttcgaactctacaccatcagcagtcncgaaccaacgtagtaacgttatttcgaacttaaacctttactacttcgtaacaaactagtaacgtttaaccgaacggttaaccccggttaggtaaccggttaccggaaccggaaaacgggtaaccgtaaaaggggaacgtaaaacgtaaccgtaaaacgacgttacggaggtacctacggacctaaccg

SEQ ID NO: 322250 - DNA, 570 bp, Homo sapiens
  misc_feature: GZ8MTXP02IVZ71.11.17.B06.1.454.CMB.2.raw
  modified_base (436)..(436): a, c, t, g, unknown or other
  misc_feature (436)..(436): n is a, c, g, or t
  modified_base (531)..(531): a, c, t, g, unknown or other
  misc_feature (531)..(531): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgagagacagagtcaccactcacttcggccgggcaagtcagatcattagcagtacttaatttaaattggtatcagcaagaaaccgaggaaacgcccctgaggtcctagatctatgctgctatcccgtagtttcgacaggtacggtcgggtacccattacgaaggttcagtgggacaggttggactcgtgccgtatagtatttccactctacacatccagctagtactcgactaaaccgtgtaaacgttnttttacactaaaccttacgtatacgtactaaacagttacgtacgaccgttaacccggtgtaccggttccggaaccggtaacggactaaaacgggngtaaaactaacgaaaacgtagtcggtagcctcgactaac

SEQ ID NO: 322251 - DNA, 590 bp, Homo sapiens
  misc_feature: GZ8MTXP02HD1YW.11.17.B06.1.454.CMB.2.raw
  modified_base (384)..(384): a, c, t, g, unknown or other
  misc_feature (384)..(384): n is a, c, g, or t
  modified_base (490)..(490): a, c, t, g, unknown or other
  misc_feature (490)..(490): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatcgacccagtcctccgtcctccctgtctgcatctggtaggagacagagtcaccatcacttcggccgggacaagtcagatcattagcagtacttaattaaagtgtatcagacaaagaaaccgaggaaccgcccgtgacgtctgatctatgctgctactcgtagttcgacgtaggtaccgggtcggtacctagtacgtaggttcagtggctaaggtgtactcgtagacganacgttactttccacttctacaaccgtataccgatcgtagtcctacgaaccgtaactaaggtaagtttactttacgaccttaaacttactacgtagtaacaaacgtntaacgttaccgaaccgtcccggtagaccggtacggaaagtaaccggggacaaacggggtacaaaacgtaacgaaaacgtacgtggacgactacgacctac

SEQ ID NO: 322252 - DNA, 542 bp, Homo sapiens
  misc_feature: GZ8MTXP02GY8YC.11.17.B06.1.454.CMB.2.raw
  modified_base (219)..(219): a, c, t, g, unknown or other
  misc_feature (219)..(219): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctcctgtctgcatctggtaggagacagagtcaccatcacttggccggnaagtcagatcattagcagcttaatttaaattggtatcagcaagaaaccgagggaaacgccccgtagacggtcctgatctatgctgcatccagtttgctagacggtcgggtccatcgagtcagtggcaggtgatcgtgcgacagtattcactctcacatcagcagtctgacctaactagtaagtatttacgacttaaacttacgtactgtacaaagtagtactacgacggttacccgtggtaccggttacggaccgaaagggaccgtaaagggtacgaaaacgttaacgaaaacggtacgtaggtacgacgtacggacctaacg

SEQ ID NO: 322253 - DNA, 746 bp, Homo sapiens
  misc_feature: GZ8MTXP02GZQYG.11.17.B06.1.454.CMB.2.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
tcagcgagagataccacgaccggtgctcgatttagtcgatagtgaagggggcaggagtcagtctcagtcaggacacagcatggacatgagggtcccccgctcagctcctggggctcctgctactctggctccgaggtgccagatgtgacatccagatcgacccagtcctccgtcctccctgtctgcatctgtagganacagatcacatcacttgccgggnaagtcagatcattagctagacttaatttaaagttggtaatcagaccaagaaacccgagggaaaccgccccgtaggacggtcctagacttacgtagtcgtactacgtacctacgttcccgtaggtttttcgaaccggtaggtaccggggttccggggtacccccaaagtttaccggtaaaacggtttccgaagggttcggggtacctaaaggggtcggtaaacgtttccgacggtaaccgtaacgtaaacgtttcttttacccaacctttcccttacccaaccgtaaacttccgaacggttaactcggtttaccacgtaaacccttaaccgttagggttaaactttacggttttacaaccctttaaacctttaaccttacgtacttaacgaaaactacggttaaccgttaaccggtaacccggttaccccgggtagggtacccggtttaccggaaaccgggttaaacggaaccgtaaaggggtacaaaacgtaacgaaaaccgtgtacgtaggtccacgactaaccg

SEQ ID NO: 322254 - DNA, 597 bp, Homo sapiens
  misc_feature: GZ8MTXP02JWBLR.11.17.B06.1.454.CMB.2.raw
tcagcgagagataccacgaccggtgctcgatttagtcgatagtgaagggggcaggagtcagtctcagtcaggacacagcatggacatgagggtccccgctcagctcccgggcctcctgctactctggctccgaggtgccagatgtgacatccagatgacccagtcctccgtcctccctgtctgcatctgtaggagacagagtcaccatcacttggccgggacaagtcagtatcattagctagtacttaatttaaatggtatcagacaagaaaccgagggaacgccccgtaggacggtcctagatctatgctgctactcctagtttcgacgaggtacggtccggggtacccagtaccgaaggttcaaggtgggcagggtaggattccgtaggacgactagtactttaccaaccttcctaccaacctatcaacgtacctagtctacgacctaaacgtgtaaagttctttacgaccttaacttactacttacgactaaacgagtacgtactacgtacccggtacggtaccgtcggaaccgtaacggaacgtaggtaacgaaactacgaaaacgtacgttggacggactacgaccacgtac

SEQ ID NO: 322255 - DNA, 554 bp, Homo sapiens
  misc_feature: GZ8MTXP02FZR3D.11.17.B06.1.454.CMB.2.raw
  modified_base (218)..(218): a, c, t, g, unknown or other
  misc_feature (218)..(218): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccggnaagtcagatcatagcagctattaatggtatcagnaagaaacaggaaancccctagagtcctgatctatgctgcatccagtttgcagacggtcggggtcccagtctaaggttcaggtggcaggtgatcgtgcgactagtatttcacttcacacccatcagtctagtctacgacctaaccgtagtaacgtattttacgactaaacttactactacgtacaaactagtaacgttaccgtacgtaaccccggttaggtaccggttaccgaaccggaaacgggaccgtaaaagggtacgaaaacgtaaccgaaacgtaacgtaggtcgacgtcgactaacc

SEQ ID NO: 322256 - DNA, 696 bp, Homo sapiens
  misc_feature: GZ8MTXP02J3TSQ.11.17.B06.1.454.CMB.2.raw
  modified_base (222)..(222): a, c, t, g, unknown or other
  misc_feature (222)..(222): n is a, c, g, or t
  modified_base (298)..(298): a, c, t, g, unknown or other
  misc_feature (298)..(298): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatcgacccagtcctccgtcctccctgtctgcatctgtagagacagagtccaccatcacttgcccgggnaagtcagatcattagcagcttaattaaattggtatacagacaagaaaccgaggaaacgcccctgacggtctgactntatgctgctagtcctagtttcgacgtagacggtcggggtaccctgtacgtaaggttcgaggtggtactaggtggattcgtcgacgtaactagttacttttacccaccttccctacccaaccctacttacgacgtaccgtacgttaccgttacggaccctaaaccgtttaacggtaacgtttaacgttttttacgaaacctttaacctttaaccttaaccgttacgtaccgtaaaaccgtaaggttaaccggtttaaccgaacccgggtttaacccccgggtacgggttacccggttaaccgggtaaaccgggaaaccgggtaaaccgggtaaacgggtaaacggtaaacgtaaacgaaaacgtaacgtacggtacgtccgttacgacccgttaacccg

SEQ ID NO: 322257 - DNA, 836 bp, Homo sapiens
  misc_feature: GZ8MTXP02FHA39.11.17.B06.1.454.CMB.2.raw
  modified_base (451)..(451): a, c, t, g, unknown or other
  misc_feature (451)..(451): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtcctccgtcctccctgtctgcatctgtaggagacgagtacaccactatacctacgtcgggaccggataacgtacgaagtactactaagttacgacgtaacgttatttaaaattttaaaggttggtaactacgaacgacaaaacgaaaaccggaagggaaacccctccgtagggtaccgtcctagtacttactagtcgtctacgactacgtaccgtttagttccgaggtaacgggttacggggtcccccgggtaaccctagtaacggttaacgttggaggtcggtacgngggtacgtacttcgtacgacggtaactaattttaccttaccacctttcccaactaacttactaacggctacggttaaccgttcaaaccgtaaaccccttaaaggttaagtaaacgtttttcttaacccgaaaacttttaaaacctttaccgtaaccttaacgttaaaaccgaaaacgttaaacgggtttaaccgtaaaccggttaccccccggggttaacccggggtaacgggtttaacccccggggttaaccgggaaaacccgggtaaaaacgggggtaaaacccggtttaaagggtaaaaaacggaaccgtttaaaaaaccggaaaaccggttaacggttcgggttaacgggtaccctacgggaacccctaacggtttaaccg

SEQ ID NO: 322258 - DNA, 591 bp, Homo sapiens
  misc_feature: GZ8MTXP02G456W.11.17.B06.1.454.CMB.2.raw
  modified_base (193)..(193): a, c, t, g, unknown or other
  misc_feature (193)..(193): n is a, c, g, or t
  modified_base (315)..(315): a, c, t, g, unknown or other
  misc_feature (315)..(315): n is a, c, g, or t
  modified_base (400)..(400): a, c, t, g, unknown or other
  misc_feature (400)..(400): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctcctgtctgcatctgtaganacagagtcaccatcacttggccggacaagtcagtatcattagcagtctaatttaaattggtatcagacaagaaaccgaggaaacgcccctagacggtcctgatctatgctgcatctagtttncgagacggtcgggcctagtacgaaggttcgagtggctaggtacggtattccgagcgaactagtatttccactctaccacactcanctacgtactcggacctaactagtaacgttatttacggaccttaaacttacgtaactgtaactaacgtaagtaacgtttacgaacggttaaccccgtagggtaccggttaccggaccggtaaacgggaaccgtaacgggtaacggtaaaactaacgaaaaccgaacgttcggacgtacgtcgaactaacccg

SEQ ID NO: 322259 - DNA, 674 bp, Homo sapiens
  misc_feature: GZ8MTXP02GP2I2.11.17.B06.1.454.CMB.2.raw
  modified_base (228)..(228): a, c, t, g, unknown or other
  misc_feature (228)..(228): n is a, c, g, or t
  modified_base (294)..(294): a, c, t, g, unknown or other
  misc_feature (294)..(294): n is a, c, g, or t
tcagcgagagataccacgaccggtgctcgatttagtcgatagtgaaggggggcaggagtcagtctcagtcaggacacagcatggacatgagggtccccgctcagctcctggggctcctgctactctggctccgaggtgccagatgtgacatccagatcgacccagtcctccgtcctccctgtctgcatctggtaggagacagagtcaccatccacgttcggccggganaagtcagatcattagcagtacttaatttaaagtggtatacagacaaacggaaaccgaagggaaccncccgtaggacggtcctagtactactatcgctcgactactccgtagttcgacgtaggtacggtccggtacctagtacgtaaggttcgaggtcgggacgtaggtacggtactcgtacggacgtaacgtagttccttaccactacctaccaacctataccgagtcgtacgtctacgaacctaaacgtagtaaacgtttagtttacaaccttaaacttacctacgtagtaaacgtaaacgtacggtaaccgttaaccgaacccgggttacccgggtacggtaaaccggggttaccggaaaacccgggtaaagggtaacccgtaaaaggggtaacaaaaccgtaaaccgtaaacggtaacgtcggacgtacgacgtacctaaccg

SEQ ID NO: 322260 - DNA, 558 bp, Homo sapiens
  misc_feature: GZ8MTXP02JDS2H.11.17.B06.1.454.CMB.2.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (269)..(269): a, c, t, g, unknown or other
  misc_feature (269)..(269): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
  modified_base (437)..(437): a, c, t, g, unknown or other
  misc_feature (437)..(437): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtagganacagagtcaccatcattgccggnaagtcagatcattagcagcttaattaattgatcagcaagaaacagggaaacncccgtgacggtctgatctatgctgcatccagtttgcaggtacgtcggggtcccagtcgtaaggttcaaggtggcaggtggatcgtgacanagtatttcnctctacacatcagctancgtnactaccgtanaagttatttacgactaacttacgtatacgtacctaaanacgtagttaaccgacggttacccggtaggtaccggttaccgggaacgaaacgggtaccgtaagggtaacggaaaacttaacgaaacggtaaaccgtggtacggtacgttacgactaacccg

SEQ ID NO: 322261 - DNA, 674 bp, Homo sapiens
  misc_feature: GZ8MTXP02GZYJ9.11.17.B06.1.454.CMB.2.raw
  modified_base (218)..(218): a, c, t, g, unknown or other
  misc_feature (218)..(218): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccggnaagtcagatcatagcagtctattaaatgtatcagacaagaaacgaggaaacgcccctgacggtcctgactctatcgtctgcacttccgtaagttttgaccgtaggacgggttccggggtacccctaagtacggtaaacggttcgaagggttcgggacgtaggtacggtacttcgtagacgacgtagttattaccacttctaccaccctatacccgagtactacgtcgtacgaacctaaccgtagtaaacgttacttttacgaaccttaaaccttaccttactacgttaaactaaaacgtacgttaaacgttaaccgtacccgggttaaccccggtaggggttacccggttaccggaaaccgggaaaacgggtaaccggtaaaacggggttaacggaaaacctaaccggtaaaaccgtaacggttcggaacggtaccgttaccggaaccttaacccg

SEQ ID NO: 322262 - DNA, 623 bp, Homo sapiens
  misc_feature: GZ8MTXP02IDM0N.11.17.B06.1.454.CMB.2.raw
  modified_base (196)..(196): a, c, t, g, unknown or other
  misc_feature (196)..(196): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtcctcccgtcctccctgtctgcatctgtagganacagagtcaccatcacttggccggacaagtcagatcaattagcagtacttaatttaaattggtatcagacaaacgaaaccgaagggaaacgccccgtaggacggtcctagactcgtatgactgctacttcctagtttcgacgtaggtacggtaccggggtacccctaagttacgtaagggtttcgaaggttgggccgtaggttggacttcgtcgacgaactagttaactttccaacttcctaccaacctagtacagtactacgtctcgacctaaccgttagtaattacttttacgacttaacttactactagttacaatacgttacgtacgtacggtacccgtacggtacgttaccggacgtaaacgggaaccgtaaggtacgtaaactaacgaaaacgtacgtaggtacgcgtacgacctacgtac

SEQ ID NO: 322263 - DNA, 598 bp, Homo sapiens
  misc_feature: GZ8MTXP02G39VC.11.17.B06.1.454.CMB.2.raw
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcacatcacttgccgggcaagtcagatcattagcagctattaaatggtatcagcaagaaaccgagggaaacgcccctagaggtcctgatctatgctgcatacctagtttgactaggacggtcggggtacccctagtacgtaaggttcaggttcgggactaggtggatcgtggacgacagtatttccgactctcaccatacagctagtctagactaaccgtgtaagtatttcgacttaaacttacctacttaggtacaaacgtagtaacgttacgaccggttaaccccggtggtaaccggttaccggaacccgtaaacggggaaacccgtaaaaggggtacgggtaaaaccttaacgaaaaccggtacgttacggacggtacttacggaccttaacccg

SEQ ID NO: 322264 - DNA, 552 bp, Homo sapiens
  misc_feature: GZ8MTXP02IYCQS.11.17.B06.1.454.CMB.2.raw
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctattaaattgtatcagcaagaaaccaggaaacgcccctgaggtcctgatctatgctgcatccagtttgcagagtcggggtcccatacgaaggttcagtggcaggtggatcgtgcgactagtatttcactctacaccatcagcagtctgacaacctgaagttattttcgactaaacttactactgtacaaactagtagttacacgttaccccggtaggtaaccggttccgggaaccgtaaacgggtaaccgtaaaggggtagtaaaaccgtaacgaaaacgtaacgttacggtacggtacgttacggacaacccg

SEQ ID NO: 322265 - DNA, 589 bp, Homo sapiens
  misc_feature: GZ8MTXP02HYSXD.11.17.B06.1.454.CMB.2.raw
  modified_base (195)..(195): a, c, t, g, unknown or other
  misc_feature (195)..(195): n is a, c, g, or t
  modified_base (284)..(284): a, c, t, g, unknown or other
  misc_feature (284)..(284): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatcgacccagtcctccgtcctccctgtctgcatctgagganacagagtcaccatccacttgccgggacaagtcagatcattagcagtcttaatttaaattggtatcagacaacgaaaccaaggggaaacncccctaggacggtcctgactctatgctgctactcctagtttcgctaggaccggtcggggtccccatacgtaaggttcgaggttggggacctaggtaggtactacgtgcgaacctagtaactttccaacttctaccaccctaatccagcagttccacgacctaacgtgtaacgttatttacgacttaaaccttactacttacgactaaacgacgtactaacgtacgtaccccggtagggtaccgtacggacgtaaacggacgtaaggagaaagtaacgaacgtaagtcggagtctacggactaccg

SEQ ID NO: 322266 - DNA, 638 bp, Homo sapiens
  misc_feature: GZ8MTXP02G4X33.11.17.B06.1.454.CMB.2.raw
  modified_base (311)..(311): a, c, t, g, unknown or other
  misc_feature (311)..(311): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatcgacccagtcctccgtcctcctgtctgcatctgtaggagacagacgtcaccatcattcggccgggacaagtcagactctattagcagtacttaatttaaagttgtatcagacaacgtaaacgaggaaaccgcccgtagacggtcctagactctangtctcgactacgtccgtagtttcgacgtacggtaacgggtccggggtacctagtaccgtaaggttcgaggtcggcgtaaggtgtactcgtagactacgtagttacttacctacttactacccgaactactacgagtaccgtagttacctacgacctaaacgttagtaagtttacgtttacacctttaaacttacgtacttaacggtaactaaacggattaaccggtactaaccggtaccggtagttaccggtacggaaccgaaacgggtaccgtaaaaggtacggaaaactaacggtaaacgtacgtacggtacgctacgactaacg

SEQ ID NO: 322267 - DNA, 621 bp, Homo sapiens
  misc_feature: GZ8MTXP02HL24V.11.17.B06.1.454.CMB.2.raw
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtccctccctgtctgcatctggtaggagacagagtccaccatcacttggccgggacaagtcagtatcaattagcagtcttaatttaaattggtatcaagcaagaaaccgagggaaaccnccccgtgacggtccngactctatgctgcattcctagtttcgacgtaggaccggtcgggtacccagtacgtaaggttcgaggtcggacgaggtgactcgtacggaccgtacaagttacctttccaccttacctaccaaccctataccgagtcctacgtcctagtacctaaaccgttaggtaacgtttatttcgaacttaaaccttactacgttacgtaaccaagtacgtacgttaacgaccggttaccgtacgggtaccgttaccggaacggtaaacgggaccgaaggttaacgaaacgtaaccgaaacggtactaggtacgactcgacctacg

SEQ ID NO: 322268 - DNA, 735 bp, Homo sapiens
  misc_feature: GZ8MTXP02HSXAI.11.17.B06.1.454.CMB.2.raw
  modified_base (221)..(221): a, c, t, g, unknown or other
  misc_feature (221)..(221): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatcgacccagtcctccgtcctccctgtctgcatctgtaggagacagatcaccatcacttggccgggnaagtcagatcattagcagctattaaatggtatcagcagaaaccgaggaaacgcccctgacggtcctagatctatgctgtcattcctaagtttcgactaggacggtcggggtaccctagtcgtaaggttcaggtcggcgtaggtaggacttcgtggacgtactagttactttcccaacttccgtacctaaccctaattacccaacggtcctacggttaccctacggtaacctaaacccgtttaggttaaaaacggtttactttttaccggtaacccttaaaaccgtttaaccttaaaccgttacggttaaaccctaaacgtaaacggtttaaacggtttaaaaccccgtaaccgggttttaaccccccggggtaggggtttaaacccgggtttacccgggaaaccccgggtaaaacggggtaacccggtaaaaggggttaaccgggaaaaacttaacccggaaaaacggttaaacccgttggtaacgggtcccgttaacggacccgttaaacccg

SEQ ID NO: 322269 - DNA, 659 bp, Homo sapiens
  misc_feature: GZ8MTXP02J2S16.11.17.B06.1.454.CMB.2.raw
  modified_base (287)..(287): a, c, t, g, unknown or other
  misc_feature (287)..(287): n is a, c, g, or t
  modified_base (350)..(350): a, c, t, g, unknown or other
  misc_feature (350)..(350): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
  modified_base (476)..(476): a, c, t, g, unknown or other
  misc_feature (476)..(476): n is a, c, g, or t
tcagcgagagataccacgaccggtgctcgatttagtcgatagtgaagggggcaggagtcagtctcagtcaggacacagcatggacatgacgggtccccgctcagctccgtggggctcctgctactctggctccgaggtgccagatgtgacatccagatcgacccagtcctccgtcctccctgtctgcatcgtaggtaggagacagacgtcaaccatctacgttggtacggactaaggtacagtattctaagttacgcgtaagtactttaaatttaaacgtggtaacncgaagaaccgaaaggaaaaccgacggggaaacctccccggtaaggtacgtcctagtatcgtancgcctagctacgttctagttcgagtaggtcccggtacggtaccagtacggtatacgnggtcgngaagttgacngtacacgtnagttacctcgctacctcaaccgtgtactacggactacgtacctnaaaccgttaagtgtaaacgttttctttacgaaacttacgttaacctacgtttaaggaaccctaaaagttccggttaaacttaacccggacccgggtttacgacgggtaaccggtaccggaaaaccgttaggggaccttaaaggaacaaacgttaacgaaacgtcgtagtcgaccttacgactg

SEQ ID NO: 322270 - DNA, 540 bp, Homo sapiens
  misc_feature: GZ8MTXP02G9C3C.11.17.B06.1.454.CMB.2.raw
  modified_base (194)..(194): a, c, t, g, unknown or other
  misc_feature (194)..(194): n is a, c, g, or t
  modified_base (364)..(364): a, c, t, g, unknown or other
  misc_feature (364)..(364): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtagganacagagtcaccatcacttgccgggcaagtcagatcattagcagcttatttaaattggtatcaaaagcaagaaaccgagggaaacgcccctgacggtcctgatctatgctgcatccagttgctagacgtcgggtaccagtcgaaggttcaggtgacaggtgatcgtgcganagtatttcactctacactatcagtcagtctacgacctaactagtaacgtatttacgactaacttactactagtacaaactagtaacgtactacggtacccgtgggaccgttaccggacgaacgggtacgaaggtacgaaactaacgaaaccgaagttcggacgtctacgactaacg

SEQ ID NO: 322271 - DNA, 584 bp, Homo sapiens
  misc_feature: GZ8MTXP02I2DCH.11.17.B06.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtagganacagagtcaccatcacttggccggnaagtcagatcatagcagcttattaatgtatcagcaagaacgaggaacgccctagacgtcctgactctatgctgctatcctagttgcgtaggacgtccggggtaccagtcgtaaggttcaggttgcgtagtggtactcgtgacgactagtacgttctactctacacctatccgagcgtacgtctagactaaaccgttagtaacgttacttttacgaccttaaactttaacctacgttactaacaacgtaacgttacgttaactaccgtacccgtaggtaccgttaccggaacgtaacgggaaccgtaaggtaacggtaactaacgaaaccgtaaagtcggtacgtacgtcgtaccgtaccgtaacg

SEQ ID NO: 322272 - DNA, 540 bp, Homo sapiens
  misc_feature: GZ8MTXP02GL7OA.11.17.B06.1.454.CMB.2.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (375)..(375): a, c, t, g, unknown or other
  misc_feature (375)..(375): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatctgtagganacagagtcacatcacttgccgggnaagtcagatcattagcagctattaaatgtatcagcagaaacaggaaagcccctgagtcctgatctatgctgcatccagtttgacagacgtcgggtccagtcaagttcagtggcagtgatctgcgacagtatttcactctcaacatcagcagtctanacaaacctagtaaacgtattttacactaaactttaacctaacgtatacaaactagaacgttaacgacgttacccggtacggtacgttaccggaccgaaacgggtaaccaaacgggttagaaaacgtaaccgaaaacgtaacgtagtagtacgtacgactaaaccc

SEQ ID NO: 322273 - DNA, 679 bp, Homo sapiens
  misc_feature: GZ8MTXP02IENMV.11.17.B06.1.454.CMB.2.raw
  modified_base (196)..(196): a, c, t, g, unknown or other
  misc_feature (196)..(196): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatcgacccagtcctccgtcctccctgtctgcatctgtagganacagagtcaccatcacgttggccgggcaagtcagatcattagcagtacttaatttaaattggtaatcaagacaaaggaaaaccgaaggggaaacctccccgtaggacggttccctagatctagtcgctgactatcctaagtttgactaggtacggtccggggtaccctagtacgtaaggtttcaggtcgggactaggtgtactcgtggactacgtagttacttccacttccttaccaaccctagttaccgagacttacggtacctacggaacccttaaaccgttaggtaaacgttttaacgtttttacgaacctttaaaaccttaccgttaaccttacgggttaaccaaacgtaaggttaaccgttaaacgtaaccggttaccccggtagggtacccggttacggaaaccggaacgggaaaccgtaaaggggtacaaaacgttaacgaaaaccgtaagtcggtacgacgttacgacccgtaac

SEQ ID NO: 322274 - DNA, 599 bp, Homo sapiens
  misc_feature: GZ8MTXP02HXPPC.11.17.B06.1.454.CMB.2.raw
  modified_base (196)..(196): a, c, t, g, unknown or other
  misc_feature (196)..(196): n is a, c, g, or t
  modified_base (379)..(379): a, c, t, g, unknown or other
  misc_feature (379)..(379): n is a, c, g, or t
tcagcgagagataccacgaccggtgctcgatttagtcgatagtgaagggggcaggagtcagtctcagtcaggacacagcatggacatgagggtcccccgctcagctcctggggctcctgctactctggctccgaggtgccagatgtgacatccagatgacccagtcctccgtcctccctgtctgcatctgtagganacagatcacatcacttggccggacaagtcagatcattagcagtcttaatttaaattggtatcaagacaaaggaaaaccgagggaaaccgtccccgtggacggttcctagacttctaatgctgcctatcctagtttcgacgtaggtacggtcggggtaccctagtacgtaagttcgagtggacngtgatcgtgacgacagttacttccactctcacctataccagctaagtctcgtaacacgtagtaaacttagtttacacttaacttactactacgtaaccaacgtaacgtaaccgttacgaacccgttacccggtggtaccggttaccggacggaaaacgggtacgaacggtaacgaaactaaaccggaaaagaccgttacggcgtccgacgtaccgtaacc

SEQ ID NO: 322275 - DNA, 720 bp, Homo sapiens
  misc_feature: GZ8MTXP02GVJIM.11.17.B06.1.454.CMB.2.raw
  modified_base (218)..(218): a, c, t, g, unknown or other
  misc_feature (218)..(218): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctcctgtctgcatctgtagagacagagtcaccatcacttgccgganagtcagatcattagcagcttaatttaaatggtatcagacaagaaaccgaggaaacgccccgtgacggttcctagatactagtgctgctagtcctagtttgacgtaggtacggtcggggtaccctagtacgtaaggttcaggttcgggacgtagggtcggtattcgtcgggacgtaacgtaaacgttcttttacccacttccctacctaaaccctaacttacccgacggtaccttaaaccgttccgtaccgaaccgtaaacccgtttaaggtaaacggtttacttttacggtaaacctttaaacgtttaaccttaacttacgtaactaaaaccggtaagttaaacgttaacccgtaaacccggtttacccgggtacgggttaaacccgggttaaccgggtaacccggtaaaaccggggaaccgttaaacggggtaaacggtaaaaaccgtaaccgtaaaaacggttaacgttacggacggtaaccgtaccgactttaaacccg

SEQ ID NO: 322276 - DNA, 619 bp, Homo sapiens
  misc_feature: GZ8MTXP02IVP8Z.11.17.B06.1.454.CMB.2.raw
  modified_base (224)..(224): a, c, t, g, unknown or other
  misc_feature (224)..(224): n is a, c, g, or t
  modified_base (388)..(388): a, c, t, g, unknown or other
  misc_feature (388)..(388): n is a, c, g, or t
tcagcgagagataccacgaccggtgctcgatttagtcgatagtgaagggggcaggagtcagtctcagtcaggacacagcatggacatgagggtcccccgctcagctcccggggctcctgctactctggctccgaggtgccagatgtgacatccagatcgacccagtctcccgtcctccctgtctgcatctgtaggagacagatccaccatcacttcggccgganaagtcagatctattagcagtctttaattaaattggtatacagacaacgaaaccgaagggaaccgccccgtaggacgtcctgactctagtgctcgactacttcgtagtttcgacgtaggtacggttccggggtacccctagtacgtaacggttcgaaggtcgggngtacggtggtactcgtacgacgtaacgtagtactttccactctaccaactactacacgtcgtatcgactaccgtaaaccgttagtaacgtatttacaccttaacttacactagtactacgtaagtacgttaacgtccggtaacccgtcgtaccggtacggaccgaaacggtaccgtaaaggaacgtaacgtaaccgtaaacgtacgacgtacggtcctacgacctataccg

SEQ ID NO: 322277 - DNA, 740 bp, Homo sapiens
  misc_feature: GZ8MTXP02HLY6G.11.17.B06.1.454.CMB.2.raw
  modified_base (240)..(240): a, c, t, g, unknown or other
  misc_feature (240)..(240): n is a, c, g, or t
tcagcgagagataccacgaccggtgctcgatttagtcgatagtgaagggggcaggagtcagtctcagtcaggacacagcatggacatggagggtccccgctcagctcctggggctcctgctactctggctccgaggtgccagatgtgacatccagatgacccagtcctccgtcctcctgtctgcatctaggtaggagacagacgtcaacctatcacgttcggccgggactaagtcaagtntacgaattacggactagtacttaattttaaaagttcggtaactcgaagaccgaaacggaaaaccgaacgggaaaaccgtccccgttaggacggttaccctagacgttactatcgtctcgactacttccgtagttcgcggtaggaccggtcgggtaccctaagtacggtaaggttaccgaggtggacgttacggtaggtacgttcgtacggtaccgaacgtaagttactttaccctaacttacccttaacaaaccgtaacttaccgagtaaccgtattaccgtacgaaaccgtaaccgttagtaaaccgttttagttaaaccacgttaaaaccttaccgtaacgtacgttaaacgaaacgtacggttaacttaccgggtaaccgttaccgggtacggttaccggtaccggtaaacccggaaacgggtaaaccgtaaaacggttaacgaaaaccgtaaccgtaaaacgtaacggtcggtagttaccgaacgtaccgtaaccg

SEQ ID NO: 322278 - DNA, 578 bp, Homo sapiens
  misc_feature: GZ8MTXP02IX3AX.11.17.B06.1.454.CMB.2.raw
  modified_base (196)..(196): a, c, t, g, unknown or other
  misc_feature (196)..(196): n is a, c, g, or t
  modified_base (275)..(275): a, c, t, g, unknown or other
  misc_feature (275)..(275): n is a, c, g, or t
tcagcgagagataccacgaccggtgctcgatttagtcgatagtgaagggggcaggagtcagtctcagtcaggacacagcatggacatgagggtccccgctcagctcctggggcctcctgctactctggctccgaggtgccagatgtgacatccagatgacccagtcctccgtcctccctgcctgcatctgtagganacagagtcacatcacttggccggcaagtcagatcattagcagtctatttaaattggtatcagcagaaaccagggaaacncccctgaggtcctgatctatgctgcatcctagtttgcaggcgtcgggtcccatcgtaaggttcagtggtagtggatctgcgactagtacttcactcctacacctatcacgtcagttcctacgactaaaccgtagtaaagtattttcgacttaacttacctactcgtaacaactaagtacgttaaccgtagtacccccggtaggtaccggttaccggaccggtaaaagggtacccgtaaaggggtaaacgtaaaacgttacgaaaaaccgtacgtacggtacgtccgtacgtactaccttaacg

SEQ ID NO: 322279 - DNA, 666 bp, Homo sapiens
  misc_feature: GZ8MTXP02HRY8N.11.17.B06.1.454.CMB.2.raw
  modified_base (221)..(221): a, c, t, g, unknown or other
  misc_feature (221)..(221): n is a, c, g, or t
tcagcgagagataccacgaccggtgctcgatttagtcgatagtgaagggggcaggagtcagtctcagtcaggacacagcatggacatgagggtcccccgctcagctcccggggctcctgctactctggctccgaggtgccagatgtgacatccagatgacccagtcctccgtcctccctgtctgcatctgtaggagacagagtcaccatcacttggccggnaagtcagatcattagcagtcttatttaaatggtatcagacaacgaaacgacgggaaacgccccgtggacggtcctgactcgtatcgctagctactcctaaggtttcgacgtaggtaggtcccggggtacctacgtccgtaaagggtttcgaacggttggccgtaaagggttggtaacttccggttaagacccgtaacgtacgttacttttcctaaccttccttaccaaccctaagttccgaacgtccaacggttccttaacggacctaaaccgttggttaaacgttacgtttttacgacctaactttaccttacgtacgttacaaacgtacgtacgttacgacccgggttacccgtagggttacccgttaccgggacgaaacggggaccgtaagggtacgtaaaactcgaaaaacgtcgtaggttcgacgtcgtaaccacttacg

SEQ ID NO: 322280 - DNA, 543 bp, Homo sapiens
  misc_feature: GZ8MTXP02I7J2D.11.17.B06.1.454.CMB.2.raw
  modified_base (219)..(219): a, c, t, g, unknown or other
  misc_feature (219)..(219): n is a, c, g, or t
  modified_base (268)..(268): a, c, t, g, unknown or other
  misc_feature (268)..(268): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggnaagtcagatcattagcagctattaaatgtatcagcagaaacaggaaacncccctgaggtcctgatctatgctgcatccagtttgcagtcggtcgggtccagtcgaagttcgagtggcaggtgactcgtgacgactagtactttacactctacactatccagctagctgaccaacgtagtaacgttatttacgaccttaacttactactgtacgaactagtacgtaacctacggttacccggtagtaccggttccggacgtaaacggggtaccgaaagggttgaaaacttaacgaaaacgaaccttggaacggtcacggactacc

SEQ ID NO: 322281 - DNA, 686 bp, Homo sapiens
  misc_feature: GZ8MTXP02G3J7O.11.17.B06.1.454.CMB.2.raw
  modified_base (101)..(101): a, c, t, g, unknown or other
  misc_feature (101)..(101): n is a, c, g, or t
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
tcagcgagagataccacgaccggtgctcgatttagtcgatagtgaagggggcaggagtcagtctcagtcaggacacagcatgggacatgagggtcccccgntcagcctcccggggctcctgctactctgggctccgaggtcgccagatgtgacatccagatgacccagtctccgtctccctgttctgcatctggtacggancaggatccaccatcacttggccggganaagtcaagatctattagctagtcttaatttaagtggtatcagacaacgtaaaccgaggaacncccctgacgtctgatctatnctgtcactccgtagtttcgacgaggtacggtccgggtacccagttaccgtaacggtcgacggtggcggtaggtacggacttcgcgtacgacgtagttacttctacctcctacacctagtacacgtacgtaacggttcctagtaaccctaaagttaggtaaaacgtttacgtttttaccggaacctttaaaccggtttacccttaacgtacgttaacgtaaacgtacggttacccgttaacgtaacccgggtttaccccgtaagggtacccggtttacgggaaccccggtaaacgggtaacgtaaacggtaacggtaaacgtaacgtaaaaccggtttaaggtaccggtacgacgttaccggaaccctacgttaacg

SEQ ID NO: 322282 - DNA, 613 bp, Homo sapiens
  misc_feature: GZ8MTXP02FJX6N.11.17.B06.1.454.CMB.2.raw
  modified_base (217)..(217): a, c, t, g, unknown or other
  misc_feature (217)..(217): n is a, c, g, or t
  modified_base (436)..(436): a, c, t, g, unknown or other
  misc_feature (436)..(436): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctcctgtctgcatctgtaggagacagagtcacatcacttgccgggnaagtcagatcattagcagctatttaaatgtatcagacaagaaaccgaggaaacgccccgtagacggtcctgatctatgctgctatcctagttgacgagtacggtcggggtacccagtcgtaaggttacaggtcgcgagtggatctgacgactaagtactttaccacttactcaaacctatacaaggctacgttcacgtacctaaacctaggtaaaagtntttaaccgacttaaactttactaactcgtaacgaactaagtaacgtttaccgacggttaaccccggtaggttaccggttacccggaaaccggtaacggggaaacccgtaaaggtaaccgggtaaaactaaaacccggaaaacggtaaccgtaggtacggtacgtaccgactaacccg

SEQ ID NO: 322283 - DNA, 636 bp, Homo sapiens
  misc_feature: GZ8MTXP02ITRYU.11.17.B06.1.454.CMB.2.raw
  modified_base (227)..(227): a, c, t, g, unknown or other
  misc_feature (227)..(227): n is a, c, g, or t
tcagcgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtcctccgtcctccctgtctgcatcgtggtaggagacagacgtccacatcgacttcggccggganaagtcagtactctagttagctaagtacttaatttaaagttggtatcgacgtacaacgaaaaccgagggaaaccgccccgtagaacggttccagtactactagtgtcgtgtcctagttccgtagtttacgacgtaggtacggtccggggtaccctagtacgtaaaggttcgagtggggacctaggtgtactcgagacgatagtacttaccgactacgtacaccgattaccagtcgtaagttcacgtacaaacgttggaaacttttgttcaactttaaacctattacgtacttaacaacggtattaacgttacgaccggttacccggtaggttaccggttaaccgacgggaaacggtaccgtaaggtaaggaaactaacggaacgtagttacgcggaactcgaccgttacg

SEQ ID NO: 322284 - DNA, 717 bp, Homo sapiens
  misc_feature: GZ8MTXP02ILO7R.11.17.B06.1.454.CMB.2.raw
  modified_base (154)..(154): a, c, t, g, unknown or other
  misc_feature (154)..(154): n is a, c, g, or t
  modified_base (196)..(196): a, c, t, g, unknown or other
  misc_feature (196)..(196): n is a, c, g, or t
tcagcgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccanatgacccagtctcccgtcctccctgtctgcatctggtagganacagatcaccatcacttgccgggacaagtcaagtatctaagttagcagcttaattaaacgttggtaatcagacacgaaaaccgagggaaacgccccgtggagtacctgactctagtgctacgtctactaccgtagtttcgcgtaaggtacggtacccggggtacccagtacgtaaggttacgtaggtacggcgtagtaggtactcgtacggtcgaaactaggtactttacaacccgtctaacctaacctacttacgaccgttaactacggttaccgttacgaacccttaaaccgttacggtaaacgtttacttttaccgtaacctttaacctttaaccgttaaccgtagttaacctaaaacgtacgttaaccgttaaaccgtacccggttaaccccggttacggtaaccggggtttaccggaacccggtaaaacgggggtaaaccgtaaacgggttaaacggtaaaactaaacccgtaaaacggtacttaacgggaccggtaacgcgtacgtaacccgtaa

SEQ ID NO: 322285 - DNA, 518 bp, Homo sapiens
  misc_feature: GZ8MTXP01EB647.51.6.A06.1.454.CMB.2.raw
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
tcagcgatcgtatacacgaccggtgctcgatttagatctactgacagggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcagggatccctgagcgattctctcggctcactcagggaacaatggtcacattgaccatcagtgatccaggcagaagacgaggctgactattcngtcaattcttcagacatnagtggtacttatgtcttcgtacgtaacggtacgaacggtacgaccgtaccgtacgttacgcgaccgaacggaccgaaccccacctacgttctaacgttcgttcccg

SEQ ID NO: 322286 - DNA, 610 bp, Homo sapiens
  misc_feature: GZ8MTXP01ANFKB.51.6.A06.1.454.CMB.2.raw
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttcgcgttaggctcttttaagaggtgtccagtgtcaggtgcagctggtgcagtctgggggaggcgtggtcagcctgggngtcctgngactctctgtgagctctgntcngctctagtagtagtggttgcgcgtcggtccgccgacggcgtccgacggacgaacgggacgtgcgtaggtgggtggcgtagtactactatatagtaagtaggaaaaggaagaactaaataaataactacgacgacgacgtacgtaggaacggtacgtactacacctactactacgacgacgaacaactaaccaaacaaacaacgtaacttaactactacgaactaaacgtaacgaacctaaccgtacgtacgtaacgtacggtaacggtaacgacggttacgtacgttacgttagttagttcgttcggttacggaagggagggaaggtagtacgttacgtaacgaacgtaacg

SEQ ID NO: 322287 - DNA, 481 bp, Homo sapiens
  misc_feature: GZ8MTXP01COF01.51.6.A06.1.454.CMB.2.raw
  modified_base (319)..(319): a, c, t, g, unknown or other
  misc_feature (319)..(319): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
  modified_base (446)..(446): a, c, t, g, unknown or other
  misc_feature (446)..(446): n is a, c, g, or t
  modified_base (463)..(463): a, c, t, g, unknown or other
  misc_feature (463)..(463): n is a, c, g, or t
  modified_base (473)..(473): a, c, t, g, unknown or other
  misc_feature (473)..(473): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgcaaccatatctatggtacagcagagcagcaggccctgtgtgtgatatataaagacactgagaggccttcagggatccctgagcgattctctcggctcnctcagggaacaatggtcacattgaccatcagtggatccaggcagaagacgaggctgactattcngtacaatcttnagacatcagtgtactatntctcgaactgggacaaggtcacgtcctggttccngcccaaggcccaacccntcgactaacncgttcccg

SEQ ID NO: 322288 - DNA, 540 bp, Homo sapiens
  misc_feature: GZ8MTXP01DPQJ3.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattcgccaaacccatattcttattggtaccagcagaagccaggccaggccctgtgttgtgatatataaagacactgagaggccttgaggatccctgagcgtattctctcggcctcacctcagggaacaatggtcactattcgaccatcagtgagtccaggcagaagacgaggctgactatttctgtacaattcttacagacatcagttggtaacttagtgttacttacggaactcggggaaccaaagggtccaccgtcccgttaagggccacgacccgaacggacccaaccccgactcgttacctaaccgttcttaaccccg

SEQ ID NO: 322289 - DNA, 499 bp, Homo sapiens
  misc_feature: GZ8MTXP01BYJ7A.51.6.A06.1.454.CMB.2.raw
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
  modified_base (462)..(462): a, c, t, g, unknown or other
  misc_feature (462)..(462): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccactattcttatggtaccagcagaagccaggccaggcccctgtgttgttgatatataaagacactgagaggccttcagggatccctgagcgattctctcggctccactcgaggaacaatggtcacattcgaccatcagtgagtccaggcagaagacgaggctgactattcngtcaatcttnagacatcagtgtacttatgtcttcggaatgggaccaaggtccacgtctaggttcncgcccaaggcccaaccccgctgcctaacgttcttccg

SEQ ID NO: 322290 - DNA, 574 bp, Homo sapiens
  misc_feature: GZ8MTXP01DTTWG.51.6.A06.1.454.CMB.2.raw
  modified_base (500)..(500): a, c, t, g, unknown or other
  misc_feature (500)..(500): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagccaccctcggtgtccgtgtccccaggacagcgccagatcacctgctcgtggagatgcattcgacccaaccacttattcttattggtaccagcagaacgccaggccacggcccctgttgttgttgatatataaacgacactagagaggtcccttacgagggtaactcccgtagacgcgtattctcgtcggtcctccacctcgacggactaaagtcggtacaactattcgaacctatacgaaggtggggtaacgttccgaaggccgaaaggaaacgaccgagggtactagtaacttatttccgtntaactaattcttacagtactattcgagttagtaacttagtcgttcgttacggaacgttcgggaacccgttaagg

SEQ ID NO: 322291 - DNA, 494 bp, Homo sapiens
  misc_feature: GZ8MTXP01CQ5UO.51.6.A06.1.454.CMB.2.raw
  modified_base (335)..(335): a, c, t, g, unknown or other
  misc_feature (335)..(335): n is a, c, g, or t
  modified_base (399)..(399): a, c, t, g, unknown or other
  misc_feature (399)..(399): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaacccatattcttattggtaccagcagaagccaggccaggcccctgtgttgttgatatataaagacactgagaggccttcgagggatccctgagcgattctctcggctcnctcagggaacaatggcacattgaccatcagtggagtccaggcagaagacgaggctgactattcngtcaatcttcagacatcagtgtactatgtctcgaatggacaaggtcacgtcctaggttccagcccaaggcccaacccncngttcaacttcgtccg

SEQ ID NO: 322292 - DNA, 532 bp, Homo sapiens
  misc_feature: GZ8MTXP01ADV0B.51.6.A06.1.454.CMB.2.raw
  modified_base (441)..(441): a, c, t, g, unknown or other
  misc_feature (441)..(441): n is a, c, g, or t
  modified_base (515)..(515): a, c, t, g, unknown or other
  misc_feature (515)..(515): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctggggaggtccctgagactctcctgtgaagcctctggattcagcttcagtacgtatggtttgcgctgggtcccgccaggctcccgaggcaagggggctgcaggtgggtggcatctatatcatatgaaaaggaagcaaataaatactacgcagactccgtagaacgggccgattcaccatcctaccagacgacaactacccaaagaaccactactttancctagacaaatcgaaaccaccctagacgactgaggaacacggctgttctattagttgttgcgaaggagggtaanagtcgatcgaacgaacg

SEQ ID NO: 322293 - DNA, 485 bp, Homo sapiens
  misc_feature: GZ8MTXP01AEDL8.51.6.A06.1.454.CMB.2.raw
  modified_base (392)..(392): a, c, t, g, unknown or other
  misc_feature (392)..(392): n is a, c, g, or t
  modified_base (455)..(455): a, c, t, g, unknown or other
  misc_feature (455)..(455): n is a, c, g, or t
  modified_base (470)..(470): a, c, t, g, unknown or other
  misc_feature (470)..(470): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcagggatccctgagcgattctctggctcactcaggaacaatgtcacattgaccatcagtgagtccaggcagaagacgagctgactattcngtcaatcttcagacatcagtgtactatgtcttcggaatgggaccaggtcacgtcctaggttcngcccaagccaacccnctgttcaacttctcg

SEQ ID NO: 322294 - DNA, 495 bp, Homo sapiens
  misc_feature: GZ8MTXP01AOLY2.51.6.A06.1.454.CMB.2.raw
  modified_base (324)..(324): a, c, t, g, unknown or other
  misc_feature (324)..(324): n is a, c, g, or t
  modified_base (460)..(460): a, c, t, g, unknown or other
  misc_feature (460)..(460): n is a, c, g, or t
  modified_base (476)..(476): a, c, t, g, unknown or other
  misc_feature (476)..(476): n is a, c, g, or t
  modified_base (485)..(485): a, c, t, g, unknown or other
  misc_feature (485)..(485): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattcnctcggctcactcagggaacaatggtcacattcgaccatcagtggagtccaggcagaagacgaggctgactattctgtcaatcttcagacatcagtgtactatgtcttcggaatgggacaggtcacgtctaggttcncgccaaggcccaaccnctcgttacncgttcgtccg

SEQ ID NO: 322295 - DNA, 500 bp, Homo sapiens
  misc_feature: GZ8MTXP01C9BTM.51.6.A06.1.454.CMB.2.raw
  modified_base (293)..(293): a, c, t, g, unknown or other
  misc_feature (293)..(293): n is a, c, g, or t
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccacctcggtgtccgtgtccccaggacagacggccaggatcacctgctctggagatgcattgccaacccactattcttattggtaccagcagaanccagccaggcccctgtgtgtgatatataaagacactgagaggccttgagggaatccctgacgcgattctctggctccacctgagggacaaatggtacacattgaccatcaagtggggacgtccgagcagaagcgaggctgtactattcngtcaattccttanaganangngttagtaattatgtcgtacgttacgtcgaacgtaacg

SEQ ID NO: 322296 - DNA, 602 bp, Homo sapiens
  misc_feature: GZ8MTXP01BAQA3.51.6.A06.1.454.CMB.2.raw
  modified_base (360)..(360): a, c, t, g, unknown or other
  misc_feature (360)..(360): n is a, c, g, or t
tcagcgatcgtatacacgaccggtgctcgatttagatctactgacaggggtctggggagacgagcccagcactggaagtcgccggtgtttccattcggtgatcatcactgaacacagaggactcaccatggagtttgggctgagcgtggtttcgcgttaggctcttttaagaggtgtccagtgtcaggtgcagctggtgcagtcgtgggggaggcgtggtccagcctggggaggtccctgagctctcctgtgaagcctctggattcagcttcagtacgtatggtttgcgctggggtcccgccaggctccgaggcaagggctgcgagtggtggcatctactatatatatagaaagaagaanaaataaataactacgacgacgacgtacgacgacggacgtactacacactactacgacgaacgaacaactaaccaaacgaaacaacgtaacttaactactacgaactaaacgtaacgtaacctaaccgtacgtacgtaacgtacgtaacggaacgtaacggttacgtacgttacgttaacgttagttaggttcggttacggtaagggagggtaaggtacgtacgttacgtaacgaacgtaacg

SEQ ID NO: 322297 - DNA, 486 bp, Homo sapiens
  misc_feature: GZ8MTXP01B5LDA.51.6.A06.1.454.CMB.2.raw
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgtgatatataaagacactgagaggccttcagggatccctgagcgattctctggctcacctcagggaacaatgtcacattgaccatcagtgagtccaggcagagacgagctgactattctgtcaatcttcagacatcagtgtactatgtntcgatggacaggtcacgtcaggttcncgcccaaggccaacccgactgttctaacgttcgtccc

SEQ ID NO: 322298 - DNA, 493 bp, Homo sapiens
  misc_feature: GZ8MTXP01AMV44.51.6.A06.1.454.CMB.2.raw
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
  modified_base (459)..(459): a, c, t, g, unknown or other
  misc_feature (459)..(459): n is a, c, g, or t
  modified_base (476)..(476): a, c, t, g, unknown or other
  misc_feature (476)..(476): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcagggatccctgagcgattctctcggctcacctcagggaacaatggtcacattgaccatcagtgagtccaggcagaagacgaggctgactattcngtcaatcttnagacatcagtgtacttatgtcttcggaatgggacaggtcacgtctaggttcngcccaaggcccaacccntcgttcaacttcgtccg

SEQ ID NO: 322299 - DNA, 591 bp, Homo sapiens
  misc_feature: GZ8MTXP01BM7BU.51.6.A06.1.454.CMB.2.raw
  modified_base (411)..(411): a, c, t, g, unknown or other
  misc_feature (411)..(411): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagagccttcagggatccctgagcgattctctcggctcactcaggaacaatgcacattgaccatcagtgagtccaggcagaagacgaggctgactagtttctgtaccaagttctttnaagtacctaattccaaggttggttaacctttaattcggttcctttaccgggaaacgttcgggggaaacccaaacgggttcccgaacccggttcccgtaacggttccgaacggacccccgaaaggggacccccaaaaccccctacgttacggttaccctaacccgtttccctttcccccgg

SEQ ID NO: 322300 - DNA, 519 bp, Homo sapiens
  misc_feature: GZ8MTXP01DUPTT.51.6.A06.1.454.CMB.2.raw
  modified_base (404)..(404): a, c, t, g, unknown or other
  misc_feature (404)..(404): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (464)..(464): a, c, t, g, unknown or other
  misc_feature (464)..(464): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggaggtccctgagactctcctgtgaagcctctggattcagcttcagttacgtatggtttgcgctgggtccgccaggctccaggcaaggggactgcaggtgggtggcatctatatcatatgaaaaggaagcaaataaatactacgcagactccgtgaagggccattcacatctcaganacaatcccaaagacacactttanccgtanacaaatcgaacacctgagtacgtgaagaacncggctgttactattagttggttgacggaaggaagggaagagtgactcgaacgaag

SEQ ID NO: 322301 - DNA, 552 bp, Homo sapiens
  misc_feature: GZ8MTXP01CAECC.51.6.A06.1.454.CMB.2.raw
  modified_base (297)..(297): a, c, t, g, unknown or other
  misc_feature (297)..(297): n is a, c, g, or t
  modified_base (352)..(352): a, c, t, g, unknown or other
  misc_feature (352)..(352): n is a, c, g, or t
  modified_base (393)..(393): a, c, t, g, unknown or other
  misc_feature (393)..(393): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttagctctttaagaggtgtccagtgtcaggtgcagctggtgcagtcgtgggggagcgtggtccagcctgggaggtccctgagactctcctgtgaagcctctggattcagcttcagtacgtatggtttgcgctgggtccnccaggctccaggcaagggactgcaggtggtgcatctatatcatatgaaaaggaantaaataaatacacgcacgactcgagacggctatcacatacncagacacaactaccaagaacactaactttatactacgaactaaagtacgaaacctacccgtagtaacgtacgtacggaacggtaacgacggttcttacgttacgttaagttagttggttgacggaaggagggaacgtacgtacgactaacgaacgaacg

SEQ ID NO: 322302 - DNA, 571 bp, Homo sapiens
  misc_feature: GZ8MTXP01CUZWZ.51.6.A06.1.454.CMB.2.raw
  modified_base (325)..(325): a, c, t, g, unknown or other
  misc_feature (325)..(325): n is a, c, g, or t
tcagcgatcgtatacacgaccggtgctcgatttagatctactgacagggggctgtgggtccaggaggcagaactctgggtgtctcaccatggcctggatcccctctacttcctccccctcctcactctctgcacaggctctgaggcctcctatgtgctgacacagccaccctggtgtccgtgtccccaggacagacggccaggatcactgctctggagatgcattgaccaaccatattcttatggtaccagcagagccaggccagccctgtgtgtgatatataaagacactgagacggccttagaggactcctgagcgtattccnctgctccacctacgagggcaaagtggtacaactattacgaaccctattacaagttcggaacgtcccgaagggaccaaaggaaagaccggtaaggacctagaaccttatttccgtagtactaaatcttaacagacatatagtaggtacttattgtcgttaacgtaacgttacggacgaacggtacgtaccgttaccgttcgttacgaacgacccgaaccggacccaacccacctcgttcgtaacccg

SEQ ID NO: 322303 - DNA, 526 bp, Homo sapiens
  misc_feature: GZ8MTXP01DP23F.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttaattggtaccagcagaagccaggccaggcccctgtgttgttgatatataaagacactgagaggccttcgagggatccctgagcgattctctcggctccactcagggaacaatggcacattgaccatcagtgagtccaggcagaagacgaggctgactattctgtcaattcttcaagacatcagtggttacttatgtacttcgggaatggaaccaaagggtccaccgtccgtaagggttcacgcccaacggcccaacccctacgtgttacctaaccgttcgttccccg

SEQ ID NO: 322304 - DNA, 545 bp, Homo sapiens
  misc_feature: GZ8MTXP01DRPZO.51.6.A06.1.454.CMB.2.raw
  modified_base (419)..(419): a, c, t, g, unknown or other
  misc_feature (419)..(419): n is a, c, g, or t
  modified_base (530)..(530): a, c, t, g, unknown or other
  misc_feature (530)..(530): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggaggtccctgagactctcctgtgaagcctctggattcagcttcagtacgtatggtttgcgctgggtccgccaggctccgaggcaagggactgcaggtgggtggcatctatatcatatgaaaaggaagcaaataaatactacgcagactccgtgaaggccgatcacatctccagacgacaactacccaaanaaccaactaactttatactagaccaaatcgaaacctaacccgtagaagtaccttaggaacggaactacgggcctcgttcgttaatttaagttggttcgacggaaggagggngatcgatcgaacaag

SEQ ID NO: 322305 - DNA, 505 bp, Homo sapiens
  misc_feature: GZ8MTXP01ECTNZ.51.6.A06.1.454.CMB.2.raw
  modified_base (442)..(442): a, c, t, g, unknown or other
  misc_feature (442)..(442): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgcattgccaacccatattcttattggtaccagcagaagccaggccaggcccctgtgttgttgatatataaagccactgagaggccttacagggaatccctgagcgtattctctggctccacctcgagggacaatcggtcacattgaccatcagtgggagtccaggcagaagcgagctgactattcngtcaattcttcagtacattcagttggttaacttatgttctacggacttcggggaacctaacgg

SEQ ID NO: 322306 - DNA, 530 bp, Homo sapiens
  misc_feature: GZ8MTXP01BRCZT.51.6.A06.1.454.CMB.2.raw
  modified_base (434)..(434): a, c, t, g, unknown or other
  misc_feature (434)..(434): n is a, c, g, or t
  modified_base (485)..(485): a, c, t, g, unknown or other
  misc_feature (485)..(485): n is a, c, g, or t
  modified_base (516)..(516): a, c, t, g, unknown or other
  misc_feature (516)..(516): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctggggaggtccctgagactctcctgtgaagcctctggattcagcttcagtacgtatggtttgcgctgggtccgccaggctccaggcaagggctgcaggtgggtgcatctatatcatatgaaaaggaagctaaataaatactacgacagactcgtagaagggccatcaccatactcaagagacaactacccaaagacaacgtactttaanctagactaaatcgaaacctaccctagagtaccttggacggaacgacggttntgttctaattagttcgttgcgtaaggagggnatcgatcaacgaag

SEQ ID NO: 322307 - DNA, 599 bp, Homo sapiens
  misc_feature: GZ8MTXP01EG5JD.51.6.A06.1.454.CMB.2.raw
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagttttggggctgagcgtggttttcgcgttaggctcttttaagaggtgtccagtgtcaggtgcagctggtgcagtctgggggaggcgtggtccagcctgggaggtccctgagactctcctgtgaagctctggattcngctntagtagtagtggttgtcgcgtcggtccgccgacggcgtccgacggacgaagggacgtgcgtaggtgggtgctatactactatatatagtagaaaagaagaactaaataaataactacgacgacgacgtacgtacgaacggacgtactacacactactacacgaacaacaacaaccaaacaacaactaacttactactacgaactaaactaacgaacaaccgtacgtaacgtaacgtacgaacggaacgtacggttacgtacgttacgttagttagttagttggttacggaagggagggaaggtagtacgttacgtaacgaacgaacg

SEQ ID NO: 322308 - DNA, 498 bp, Homo sapiens
  misc_feature: GZ8MTXP01BGC40.51.6.A06.1.454.CMB.2.raw
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (484)..(484): a, c, t, g, unknown or other
  misc_feature (484)..(484): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagaggccttcagggatccctgagcgattctctcggctccacctcagggaacaatggtcacattgaccatcagtgagtccaggcagaagacgaggctgacttagttctgtcaatcttnagacntcagtggtacttatgtcttacggaactgggacaggtcaccgtctagttcgacgcccaagccaacccnctgcaacttctccg

SEQ ID NO: 322309 - DNA, 513 bp, Homo sapiens
  misc_feature: GZ8MTXP01DV2E2.51.6.A06.1.454.CMB.2.raw
  modified_base (332)..(332): a, c, t, g, unknown or other
  misc_feature (332)..(332): n is a, c, g, or t
  modified_base (406)..(406): a, c, t, g, unknown or other
  misc_feature (406)..(406): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgcccaacccactattcttattggtaccagcagaagccaggccaggcccctgtgttgtgatatataaagacactgagaggcctttcagggatccctgagcgattccnctggctccacctcagggcaatgtcacattgaccatcagtggagtccaggcaagaagacgaggctgacttattcnggtcaatcttacagcatcagtgtacttatgtcttcggaacttgggaaccaggtccaccgttcccgttgggttcaacggccaacggcccaacccactcgttctaaccc

SEQ ID NO: 322310 - DNA, 518 bp, Homo sapiens
  misc_feature: GZ8MTXP01CBGPR.51.6.A06.1.454.CMB.2.raw
  modified_base (402)..(402): a, c, t, g, unknown or other
  misc_feature (402)..(402): n is a, c, g, or t
  modified_base (450)..(450): a, c, t, g, unknown or other
  misc_feature (450)..(450): n is a, c, g, or t
  modified_base (469)..(469): a, c, t, g, unknown or other
  misc_feature (469)..(469): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaaacccactattcttattggtaccagcagaagccaggccaggcccctgtgttgttgatatataaagaccactgagaggccttacgagggctcccgtgacgcgattctctggctccacctcgagggacaagtggtcanattgaccatcagtggacgtccgagcaagaagacgagctgtactattcngtctaattcttcagtactnttcgttggttgttaactatcgttcgttcggaacttgggaaccgtaacgg

SEQ ID NO: 322311 - DNA, 554 bp, Homo sapiens
  misc_feature: GZ8MTXP01DTZOP.51.6.A06.1.454.CMB.2.raw
  modified_base (404)..(404): a, c, t, g, unknown or other
  misc_feature (404)..(404): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaaccactattctattggtaccagcagaagccaggccaggcccctgtgttgttgatatataaaagacactgagaggccttcgagggatccctgagcgattctctggctccactcagggaacaatggtcacattgaccatcagtgatccaggcagaagacgaggctagactaatttcttntataacttcttactagacatagtagttagttacttagttgttacgttacggtaacggtaacggtaacgaacggtacgttaccgtaccgtacgttacgaccgacccgaaccgacccgaacccctacctacgttacctaaccgttccgtccg

SEQ ID NO: 322312 - DNA, 494 bp, Homo sapiens
  misc_feature: GZ8MTXP01CDUJF.51.6.A06.1.454.CMB.2.raw
  modified_base (398)..(398): a, c, t, g, unknown or other
  misc_feature (398)..(398): n is a, c, g, or t
  modified_base (464)..(464): a, c, t, g, unknown or other
  misc_feature (464)..(464): n is a, c, g, or t
  modified_base (481)..(481): a, c, t, g, unknown or other
  misc_feature (481)..(481): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctcggctcacctcagggaacaatggtcacattgaccatcagtgagtccaggcagaagacgaggctgactattcngtcaatcttcagacatcagtggtacttatgtcttcggaactgggaccagggtccacgtctggttcngcccaaggccaaacccntgcaacttctccg

SEQ ID NO: 322313 - DNA, 511 bp, Homo sapiens
  misc_feature: GZ8MTXP01AILC2.51.6.A06.1.454.CMB.2.raw
  modified_base (348)..(348): a, c, t, g, unknown or other
  misc_feature (348)..(348): n is a, c, g, or t
  modified_base (470)..(470): a, c, t, g, unknown or other
  misc_feature (470)..(470): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacgccaggatcacctgctctggagatgcattgcccaaccactattcttattggtaccagcagaagccaggccaggcccctgtgttgttgatatataaagacactgagagccttacagggntccctgagcgattctctggcctccacctcgagggacaagtggtcactattcgaccatcagtgggagtccgaggcagaagacgagtctgtactattctgtaacaattcttacagtacattcgngttggtaacttagtgtcttacggacttgggaacctaacggg

SEQ ID NO: 322314 - DNA, 637 bp, Homo sapiens
  misc_feature: GZ8MTXP01BWR7O.51.6.A06.1.454.CMB.2.raw
  modified_base (259)..(259): a, c, t, g, unknown or other
  misc_feature (259)..(259): n is a, c, g, or t
  modified_base (280)..(280): a, c, t, g, unknown or other
  misc_feature (280)..(280): n is a, c, g, or t
  modified_base (332)..(332): a, c, t, g, unknown or other
  misc_feature (332)..(332): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttccgtcgttaggctctttaagaggtgtccagtgtcaggtgcagctggtgcagtcgtgggggagcgtggtccagcctggggaggtccctgagctctcctgtgaagcctntggattcagcttcagtacgtntggtttgcgcgtgggtcccgccaggcctccgaggcaaagggggtcctggcgnggtgggtggctatctactatatatagtagaaaaggaagaataaataaataactacgacgaacgacgtaccggtacggaacggacgtactacacctactactaccgaacgaacgaacaaactaaccaaacgtaaacctaacctaactttacttactacgtaactaaacgtaacgtaaccgtaacccgtacgtaacgtaacgtacggacggaaccggtaccggttacgttacgttacgttaagtttagtttagttcggttacgggaagggtagggtaaggtacgtacgttacgtaacgaacgtaacg

SEQ ID NO: 322315 - DNA, 488 bp, Homo sapiens
  misc_feature: GZ8MTXP01ATFCF.51.6.A06.1.454.CMB.2.raw
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
  modified_base (454)..(454): a, c, t, g, unknown or other
  misc_feature (454)..(454): n is a, c, g, or t
  modified_base (471)..(471): a, c, t, g, unknown or other
  misc_feature (471)..(471): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccatattcttattggtaccagcagaagccaggccaggcccctgtgtgttgatatataaagacactgagaggccttcagggatccctgagcgattctctcggctcacctcagggaacaatggtcacattgaccatcagtgagtccaggcagagacgagctgactnttcngtcaatcttnagacatcagtgtactatgtctcgactggaaccaggtcaccgtctagttcncgcccaaggccaacccntcgctaacttcttcccg

SEQ ID NO: 322316 - DNA, 559 bp, Homo sapiens
  misc_feature: GZ8MTXP01A9YOB.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggtccctttgtgtgatatataaagacactgagagcttcgagggatccctgagcgtattctctggccctccactcgagggacaaagtggtcacattgaccatcagtgagtcaggcagaagacgaggctgacttattctgtacaatcgttacagtacatcagttcggtacttagtgtcgttacggaacgtcgggaacctaagggttctacccggttccgtaaaggggtccaacggccccgaaacgggaaccccaaacccccgtaacttccggtccaccttccgttcccggtttcccccg

SEQ ID NO: 322317 - DNA, 514 bp, Homo sapiens
  misc_feature: GZ8MTXP01B0KYY.51.6.A06.1.454.CMB.2.raw
  modified_base (483)..(483): a, c, t, g, unknown or other
  misc_feature (483)..(483): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgtgatatataaagacactgagaggccttcgagggatccctgagcgattctctcggaccttccacctcgaggggaaccaaagtcggtacaaccatttcgacccatcgagtggagtccgaggcaagaagacgaggctgacttattctagtcaatcttcagacatcagtgtacttatgtcttcgaacgtgggacaggtcacgtcctggttcngcccaagcccaaccacngttcncgttctccg

SEQ ID NO: 322318 - DNA, 633 bp, Homo sapiens
  misc_feature: GZ8MTXP01ETYNR.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccacctcggtgtccgtgtccccaggacagacggccaggatcacctgctctggagatgcattgcccaaacccattattcttattggtaccagcagaagccaggccaggcccctgtgttgtgatataataaagacactgagaggtccttgagggtactcccgtgagcgtattctcgtcggccttaccaccgtcgaacggggaaaccaaagttggtacaactagtttacgaacctatcgaaggttgggaacgtccgaagggcaaggaaacgaacggagggtctaggaaccttaagtttcctagttactaaagttctttacgaagtaccaagttcgaagtttggttaaactttgtgttacgttacggaaacttgggggaacccttaaaggggttccaacccggttaccgttacgggttaccacggaccccgaaacgggccccaaacccctagtccgttacctaaccgttcgttccccg

SEQ ID NO: 322319 - DNA, 550 bp, Homo sapiens
  misc_feature: GZ8MTXP01C3NPR.51.6.A06.1.454.CMB.2.raw
  modified_base (529)..(529): a, c, t, g, unknown or other
  misc_feature (529)..(529): n is a, c, g, or t
  modified_base (544)..(544): a, c, t, g, unknown or other
  misc_feature (544)..(544): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtggggggaggcgtgggtccagcctggggagtccctgagactctcctgtgaagcctctggattcagcttcagtacgtatggtttgcgctgggtcccgccaggctccaggcaaggggactgcaggtgggtgcatctatatcatatggaaaaggaagcaaataaatactacgcagactccgtagaacgggccattcaccatctccagaacgacaaactaccccaaagaaccaactaactttatacctagaccaaatcgaaaccaaccctgaacgtacttcgaaggaaccacgggcttggacttaagttattagacggagaagggganaagtcgattcaacgngaaccg

SEQ ID NO: 322320 - DNA, 667 bp, Homo sapiens
  misc_feature: GZ8MTXP01CRS4E.51.6.A06.1.454.CMB.2.raw
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggtttcgcgttaggctctttaagaggtgtcagtgtcaggtgcagctggtgcagtcgtgggggagcgtggtccagcctgggaggtccctgagctctcctgtgaagccctntggattcngctctagtacgtagtggttgtcgtcgtcggtccgccgacgcgtcgacggacgaacggacgtgcgtaggtgggtggtacgtagtactactatacgtagtaagtaggaaaaggaaagaacgtaaaataaaactaaacgtacgacgaacgtacgtaccggtacggtaacggtaccgtacgtacctacctactacgtaccgaacgaacgaactaaacctaaccgaaacgtaaacctaaccgttaactttaacttacgtacgtaactaaacgtaacgtaaccgtaacccgtacgtaacgtaacgtacggtaacggtaacgtaacggttacgtacgttacgttaacgttagttacggttcggttacggtaaggtagggtaacgtacgtacgttacgtaacgaacgtaacg

SEQ ID NO: 322321 - DNA, 488 bp, Homo sapiens
  misc_feature: GZ8MTXP01CJ7W1.51.6.A06.1.454.CMB.2.raw
  modified_base (396)..(396): a, c, t, g, unknown or other
  misc_feature (396)..(396): n is a, c, g, or t
  modified_base (423)..(423): a, c, t, g, unknown or other
  misc_feature (423)..(423): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagaggccttcagggatccctgagcgattctctcggctcacctcagggaacaatggtcacattcgacatcagtgagtccaggcagaagacgagctgactattcngtcaatcttcagacatcagtgtacttntgtctgactggacaggtcacgtctggttcacgcccaaggcccaacccatcgttcaacttcttccg

SEQ ID NO: 322322 - DNA, 612 bp, Homo sapiens
  misc_feature: GZ8MTXP01AVG68.51.6.A06.1.454.CMB.2.raw
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagatcgtcctgagggactcctgacgcgtattctcgtcggtctacccaccgtacgaaacgggaactaagttcggtaaccaactacgttacgacctattacgaggtggacgtcgaggcgaaggaacggacggacgtcgtagtacttatttcgtagtactaatttcttacaagtactagtacgtaggttacggttacttagtcgtttacgtcggtaacggtcgggaaccgtaacggttcccgtaccgttacgttacggttccaaccggaacccgaacggaaccccctaaacccgtcgttaccgtcccgttaaccgttccccg

SEQ ID NO: 322323 - DNA, 507 bp, Homo sapiens
  misc_feature: GZ8MTXP01BSJTX.51.6.A06.1.454.CMB.2.raw
  modified_base (422)..(422): a, c, t, g, unknown or other
  misc_feature (422)..(422): n is a, c, g, or t
  modified_base (473)..(473): a, c, t, g, unknown or other
  misc_feature (473)..(473): n is a, c, g, or t
  modified_base (489)..(489): a, c, t, g, unknown or other
  misc_feature (489)..(489): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaaacccattattcttattggtaccagcagaagccaggccaggcccctgtgttgttgatatataaagacactgagaggccttcgagggactccctgagcgattctctcggctccacctcagggaacaatggtacacattcgacctatcagtgagtccgaggcaagaagacgaggctgacttattctgtcaatcttnagactatcagtgtacttatgtctcgatggaccaaggtcacgtctagttcgngcccaagcccaacccntcgactaacgttcgtccc

SEQ ID NO: 322324 - DNA, 574 bp, Homo sapiens
  misc_feature: GZ8MTXP01BGDIM.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaacccactattcttattggtaccagcagaagcaggccaggcccctgtgttgttgatatataaagacactgagaggccttcgagggatccctgagcgtattctctcggctccactcaggaacaatgcacattgacatcagtgagtccaggcagaagacgaggctgacttagttctagtcaagtctttcaagactagtccgtaggttaggttaaccttaagttcgttacgttaccgggtaaacgtcggggtaaaccttaaaggggtcccacccggttaccgtaaggttccgacggaccccaaaacgggccccaaaccccgtactcggttaccctaaccgttcctttccccg

SEQ ID NO: 322325 - DNA, 566 bp, Homo sapiens
  misc_feature: GZ8MTXP01D4K01.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtcccgtgtccccaggacagacggccaggatcacctgctctggagatgcattgacccaaacccactattcttattggtaccagcagagcaggccaggccctgtgttgtgatatataaagacactgagaggccttgaggatccctgagcgtattctctcggctccactcaggaacaatggtcaacgtattgaccatcagtgatcgaggcagaagacgaggctgacttagttcagtacaattcttacaagacaattcgagttcggttaacttagttgttcgttacggtaacgtcgggaaccagggtaccttacccggttaccgtaacggggttaccacggaccccgaaacgggaccccaacccctaacgtcgttcctaaccgtttcccgtttccccgg

SEQ ID NO: 322326 - DNA, 517 bp, Homo sapiens
  misc_feature: GZ8MTXP01DETHL.51.6.A06.1.454.CMB.2.raw
  modified_base (359)..(359): a, c, t, g, unknown or other
  misc_feature (359)..(359): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (473)..(473): a, c, t, g, unknown or other
  misc_feature (473)..(473): n is a, c, g, or t
  modified_base (483)..(483): a, c, t, g, unknown or other
  misc_feature (483)..(483): n is a, c, g, or t
  modified_base (503)..(503): a, c, t, g, unknown or other
  misc_feature (503)..(503): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctggggtcccgccaggctccgaggcaaggggactgcaggtgggtggcatctatatcatatgaaaagggaancaaataaaatactacgcagactccgtgaagggccgattcaccatctccanacgacaancccaaagaacactactttanacctanacaanacacacagtagactagagaacgcgntgttctattnttgttgcgaaggaggaaganagataacaacgaag

SEQ ID NO: 322327 - DNA, 515 bp, Homo sapiens
  misc_feature: GZ8MTXP01BMOO1.51.6.A06.1.454.CMB.2.raw
  modified_base (477)..(477): a, c, t, g, unknown or other
  misc_feature (477)..(477): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggccctgtgttgttgatatataaagacactgagaggcttcgagggatccctgagcgattctctcggcctcactcgagggaacaatggtcaacattcgaccatcagtgagtccaggcagaagacggaggctgactattctgtcaagttcttacagacatcgagttggtacttatgttcttcggaactgggaccaagggtccaccgtctaggttcncggcccaaggcccaacccgctcgctaacttcgttcccg

SEQ ID NO: 322328 - DNA, 532 bp, Homo sapiens
  misc_feature: GZ8MTXP01EREUY.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccacttattcttattggtaccagcagaagccaggccaggcccctgtgttgttgatatataaagacactgagaggcttcagggatccctgagcgattctctggctcactcagggaacaatgtcacattgaccatcagtgatccaggcagaagacgaggctgactattctgtcaatcttacagacatcagtggttattatagttcgttcggtaacgtaaggtaacgttaaacggtacgttaccgtaccgtacggttcgacgaccaacgggacccgaacccacctcgttactaaccgttcgtttccccg

SEQ ID NO: 322329 - DNA, 536 bp, Homo sapiens
  misc_feature: GZ8MTXP01CVL64.51.6.A06.1.454.CMB.2.raw
  modified_base (234)..(234): a, c, t, g, unknown or other
  misc_feature (234)..(234): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccnctattcttattggtaccagcagagcaggccaggccctgtgtgtgatatataaagacactgagaggcctttgagggactccctgacgcgattccctctggctcccacctcagggaacaaagtggtacacattgaccatcagtggagtccaggcaagaagacgaggctagactatttctggtctaaatcttacagacatatagtgtacgttattgttcgttaacgtaacgttacggtacgaacgtacgtaccgttaccgttcgttacgaacgaccgaacgaccaacccacctcgttcgtaaccc

SEQ ID NO: 322330 - DNA, 516 bp, Homo sapiens
  misc_feature: GZ8MTXP01BT8LS.51.6.A06.1.454.CMB.2.raw
  modified_base (353)..(353): a, c, t, g, unknown or other
  misc_feature (353)..(353): n is a, c, g, or t
  modified_base (423)..(423): a, c, t, g, unknown or other
  misc_feature (423)..(423): n is a, c, g, or t
  modified_base (500)..(500): a, c, t, g, unknown or other
  misc_feature (500)..(500): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggaggtccctgagactctcctgtgaagcctctggattcagcttcagtacgtatggtttgcgcgtgggtcccgccaggctccgaggcaagggctgcaggtgggtgcatctatatcatatgaaaagancaaataaatactacgcagactcgtagaacggcatcacatcacagagacaatcccaaagacactactttanctagacaaatcgaaaccaccctgaacgtactgaggaacacgggctagttctaattattggttgcggaaggagggaanatcgatcgaacgaacg

SEQ ID NO: 322331 - DNA, 541 bp, Homo sapiens
  misc_feature: GZ8MTXP01ANUM5.51.6.A06.1.454.CMB.2.raw
  modified_base (408)..(408): a, c, t, g, unknown or other
  misc_feature (408)..(408): n is a, c, g, or t
  modified_base (422)..(422): a, c, t, g, unknown or other
  misc_feature (422)..(422): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttatggtaccagcagagcagcaggccctgtgtgtgatatataaagacactgagaggccttcgagggactcccgtgagcgtattctctcggctcacctgaggaacaagtggtacactattcgacctatcgaagtggacgtccgaggcaagaagacgaggctgacttatttcngtcaactcttcaanacatgtagtagttacttagtcgtacgtacgtacgtaacggtaacgacgtaccgttaccgtacgtacgttacgaccgaccgaaccgacccgaacccactacgttacctccgttcgtcccg

SEQ ID NO: 322332 - DNA, 503 bp, Homo sapiens
  misc_feature: GZ8MTXP01CR2M1.51.6.A06.1.454.CMB.2.raw
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
  modified_base (465)..(465): a, c, t, g, unknown or other
  misc_feature (465)..(465): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagcactgagaggcttcagggatccctgagcgattctctcggctcactcagggaacaatggcacattgaccatcagtgagtccaggcagaagacgaggctgactattcngtacaatcttcagacntcagttggtacttatgtcttcggaacttgggacaaaggtcaccgtctaggttcnggccccaaggcccaaccccgctggcaacgttcttcccg

SEQ ID NO: 322333 - DNA, 525 bp, Homo sapiens
  misc_feature: GZ8MTXP01CWA0J.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtcccgtgtcccccaggacagacggccaggatcacctgctctggagatgcattgccaaacccactattcttattggtaccagcagaagccaggccaggcccctgtgttgttgatatataaagacactgagaggccttcagggactccctggagcgattctctcggcctccacctcagggaacaatggtcacattgaccatcagtgagtccaggcagaagacgaggctgacttattctgtcaattcttcagacatcagtggtacttatgtcgttcggaatcgggaaccttaaggtccacccgttcgtacgggttcacgcccaaggaccccaacccgatcgctaaccgttcttcccg

SEQ ID NO: 322334 - DNA, 570 bp, Homo sapiens
  misc_feature: GZ8MTXP01ATOU8.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggatcacctgctctggagatgcattcgccaaacccatattcttattcggtaccagcagaagccaggccaggccctgtgttgtgatatataaagacactgagaggccttacgagggactcccgtgagcgtattctcgtcggctccacctcgagggaactaagtgtacactattgaccatcagtgagtccgaggcaagaagacgaggctagacttagtttctagtacaattcttacaagacctatacgagttaggttaacttagttcgttacgttcggaacgttgggaaccgttaaagggtccttaacccggtcctagggttccgacgaccccgaacggcccaacccctatcgttacctaaccgttccttcccg

SEQ ID NO: 322335 - DNA, 589 bp, Homo sapiens
  misc_feature: GZ8MTXP01CRUVA.51.6.A06.1.454.CMB.2.raw
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (436)..(436): a, c, t, g, unknown or other
  misc_feature (436)..(436): n is a, c, g, or t
  modified_base (449)..(449): a, c, t, g, unknown or other
  misc_feature (449)..(449): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctggggagtccctgagactctcctgtgaacgcctctggattcagcttcagttacgtatggtttgcgcgtgggtcccgccaggcctccaggcaaggggctgcgaggtgggtgcatctatatnatanagaaaagggaaanaacaaataaactacgacgacagactcgtagaacggcctattaccacctatacctacaagacaacaactaaccaanaacactactttanctacgaactaaatacgaacctaccgtagtaacgtacgtaggaacggtaacgtacggttcttagttacgtttaaagtttagttaggttcggaacggtaagggaaggggtaacgtacgtacgttaactaaccgaacgtaacg

SEQ ID NO: 322336 - DNA, 491 bp, Homo sapiens
  misc_feature: GZ8MTXP01BX2XU.51.6.A06.1.454.CMB.2.raw
  modified_base (394)..(394): a, c, t, g, unknown or other
  misc_feature (394)..(394): n is a, c, g, or t
  modified_base (473)..(474): a, c, t, g, unknown or other
  misc_feature (473)..(474): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccagccaggccctgtgtgtgatatataaagacactgagaggccttcagggatccctgagcgattctctcggctcacctcaggaacaatggtcacattcgaccatcagtgatccaggcagaagacgagctgactatttcngtcaatcttcaagacatcagtgtactatgtctgaactggaacaggtcaccgtctaggttcacgcccaacggccaacccnncgttcaacgttcttccg

SEQ ID NO: 322337 - DNA, 521 bp, Homo sapiens
  misc_feature: GZ8MTXP01BPQH0.51.6.A06.1.454.CMB.2.raw
  modified_base (319)..(319): a, c, t, g, unknown or other
  misc_feature (319)..(319): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (470)..(470): a, c, t, g, unknown or other
  misc_feature (470)..(470): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccatattcttattggaccagcagaagcagccaggccctgtgtgtgatatataaagacactgagaggccttcagggatcccgtgagcgattcnctcggctcactcaggaacaatggtcacattcgacatcagtgagtccaggcagaagacgagcngactagttcngtacaagtcttanagacatcagtgtacttatgtcttcggaacttgggaaccttagggtccacggtacctagggttaccncgaccccgaacggccccaacccctacgttcggacctaacgttccgttcccg

SEQ ID NO: 322338 - DNA, 559 bp, Homo sapiens
  misc_feature: GZ8MTXP01D03X8.51.6.A06.1.454.CMB.2.raw
  modified_base (355)..(355): a, c, t, g, unknown or other
  misc_feature (355)..(355): n is a, c, g, or t
  modified_base (397)..(397): a, c, t, g, unknown or other
  misc_feature (397)..(397): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggagtccctgagactctcctgtgaagcctctggattcagcttcagtacgtatggtttgcgcgtgggtccgccaggctccgaggcaaggggactggcaggtgggtgcatctatatcatatagaaaggaancaaataaactactacgcagactcgtagaacggcatcacatcncagacgacaactacccaaagaacactaactttatctacgacaaacgtacgaaaccaccctaggaacgtacgttaggaacggaaccgtacgggttcttacgttacttaagtttaagttggttggacgtaagggagggaagtactacggataacgaacgaacgg

SEQ ID NO: 322339 - DNA, 488 bp, Homo sapiens
  misc_feature: GZ8MTXP01APCUM.51.6.A06.1.454.CMB.2.raw
  modified_base (395)..(395): a, c, t, g, unknown or other
  misc_feature (395)..(395): n is a, c, g, or t
  modified_base (456)..(456): a, c, t, g, unknown or other
  misc_feature (456)..(456): n is a, c, g, or t
  modified_base (471)..(471): a, c, t, g, unknown or other
  misc_feature (471)..(471): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacacctgagaggccttcaggatccctgagcgattctctcggctcactcaggaacaatgtcacattgaccatcagtgagtccaggcagaagacgaggctgactatttcngtcaatcttacagacatcagtggtacttatgtcttcggatggacaggtcacgtctagttcngcccaagccaacccnctgttcaacttcgtccg

SEQ ID NO: 322340 - DNA, 545 bp, Homo sapiens
  misc_feature: GZ8MTXP01DZ6D0.51.6.A06.1.454.CMB.2.raw
  modified_base (467)..(467): a, c, t, g, unknown or other
  misc_feature (467)..(467): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctcctatgtgctgacacagcccaccctggtgtccgtgtccccaggacagacgccaggatcacctgctctggagatgcattcgcccaacccatattcttattggtaccagcagaagccaggccaggcccctgtgttgtgatatataaagaccactgagagtccttacgagggtctccctgacgcgtattctctcggcctccacctcgagggacaagtcggtacactattacgaccatacgaggttggggacgtccgaggacaaggaagacggaggactgtacttattcgntaactaattcttacagactattacgttgttagttaacttattcgttcgttacggttacgtaacggttaacgtaaccgg

SEQ ID NO: 322341 - DNA, 545 bp, Homo sapiens
  misc_feature: GZ8MTXP01A4LI1.51.6.A06.1.454.CMB.2.raw
  modified_base (384)..(384): a, c, t, g, unknown or other
  misc_feature (384)..(384): n is a, c, g, or t
  modified_base (400)..(400): a, c, t, g, unknown or other
  misc_feature (400)..(400): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccatattcttattggtaccagcagaagccaggccaggcccctgtgttgttgatatataaagacactgagaggccttcagggatccctgagcgattctctggctcactcagggaacaatggtcacattgaccatcagtgagtccagggcagaagacgggngtgacgtattcttgtntaactacgttctagacactactagtaggttacgttattgttcgttacggttaacgtaggtaaccggtaaacgttacggtaccgttaccgtacggttacgacgccgaccgaaccgaaccccaacctcgtcactccttcgttccccg

SEQ ID NO: 322342 - DNA, 673 bp, Homo sapiens
  misc_feature: GZ8MTXP01BNSZ1.51.6.A06.1.454.CMB.2.raw
  modified_base (206)..(206): a, c, t, g, unknown or other
  misc_feature (206)..(206): n is a, c, g, or t
  modified_base (362)..(362): a, c, t, g, unknown or other
  misc_feature (362)..(362): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctctatgtgctgacacagccacctggtntccgtgtccccaggacagacgccaggatcacctgctctggagatgcattcgcccaacccactattcttattggtaccagcaagaacgccgaggccacggcccctgtgttgttagaatataataaacgaccacgtagagacgcccttaagacgggtntccctgaacgtccgtaattccgtcgtacgggccttacccgaacccgttacgaacggggaacctaaagtcgggttacaaccgtatttacggaaaccctattaccgtaagggttacgggggaacgttaccccggaaagggacccgaaagggaaacggtaaccgggaacggtaccgttaggtaacctttaaggttttcaacggttaactaaacgttctttacgaaacgtaactaacttacggttagtttaccgggttaaacttgttaacggttaccgttaacgggttaacgttcggggttaaaccctaacgggg

SEQ ID NO: 322343 - DNA, 517 bp, Homo sapiens
  misc_feature: GZ8MTXP01BKWTH.51.6.A06.1.454.CMB.2.raw
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccatattctatggacagcagagccagccaggccctgtgtgttgatatataaagcactgagaggccttnaggtatccctgancgattcnctcggctcacctcaggaacaatggtcacattgaccatcagtgagtcaggcagaagacgaggctgactattctagtcaagtctttacagacatacagtaggtacttatagtcgttcgtaacgtaaggtacgaacggtacgaccgtaccgtacgttacgacgaccgaacggaccaacccacctacttactaaccgttcgttcccg

SEQ ID NO: 322344 - DNA, 695 bp, Homo sapiens
  misc_feature: GZ8MTXP01A2N17.51.6.A06.1.454.CMB.2.raw
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggatcacctgctctggagatgcattcgacccaacccattattcttattggtaccagcagagccaggccaggccctgtgtgtgatatataaagacactagagaggcctttcgagggtactccctgagcgtattccctacgtggcctcccacctacgaagggaacaaagtcgggtacaactagttacgacctattccgaagttagggacgtcccgagggacaaagggaaaggaccgggaggccgttaggtaactttattttaccgtaggggttactaaacgtttcctttacaacggtaaccctaagttccgtaagggttcggtttaacctttagtttacggttaccggtttaaccgggaaaccggttcgggggtaaaccccttaaagggggttacccctaacccgggtttacccgttaacgggttcccgtaaacccggacccccgaaacgggacccccctaaaccccgaaccgttccggttaaccccgtaaccccg

SEQ ID NO: 322345 - DNA, 521 bp, Homo sapiens
  misc_feature: GZ8MTXP01BFLHZ.51.6.A06.1.454.CMB.2.raw
  modified_base (414)..(414): a, c, t, g, unknown or other
  misc_feature (414)..(414): n is a, c, g, or t
  modified_base (425)..(425): a, c, t, g, unknown or other
  misc_feature (425)..(425): n is a, c, g, or t
  modified_base (443)..(443): a, c, t, g, unknown or other
  misc_feature (443)..(443): n is a, c, g, or t
  modified_base (482)..(482): a, c, t, g, unknown or other
  misc_feature (482)..(482): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaacccactattcttattggtaccagcagaagccaggccaggcccctgtgttgttgatatataaagacactgagaggccttgagggactcccgtgagcgtattctctcggcctccacctcgagggaacaatggtcactattcgaccatcgagtggatccgaggcaagagacgagctgacttattcngtacagttctnagacatcagtggtacttntgtcttcggacgtgggaccaaggtcaccgtcgtagttcncgacccaaggcccaacccgctcgttctaacgttctcccg

SEQ ID NO: 322346 - DNA, 601 bp, Homo sapiens
  misc_feature: GZ8MTXP01B8EFX.51.6.A06.1.454.CMB.2.raw
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtgggggaggcgtggtccagccgtgggagtccctgagactctctgtgaagcctctggattcagcttcagttacgtatggtttgcgtcgtgggtcccgccgaggcctccgaggcgaaggggactggcgaggtgggtgcatctatatcatanagaaagancaaataaanactacgcagactcgtagacggcatcacatcctacagacgacaactacccaaagaacctactaacttttacactacgaactaaaactacgaaaccaacccgtgaacggtacttacgggaacggaacctaacggggttcttacggttactttaagtttacgtttagggttcggacgggtaaggggaaggggtaacgtaagtacccggttaataacccggaaacgtaaccgg

SEQ ID NO: 322347 - DNA, 498 bp, Homo sapiens
  misc_feature: GZ8MTXP01CUGKT.51.6.A06.1.454.CMB.2.raw
  modified_base (350)..(350): a, c, t, g, unknown or other
  misc_feature (350)..(350): n is a, c, g, or t
  modified_base (443)..(443): a, c, t, g, unknown or other
  misc_feature (443)..(443): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgtgttgatatataaagaccactgagaggccttacagggntccctgagcgattctctggcctccacctcgagggacaagtggtcacattcgacatcagtggggagtccgagcagaagcgaggctgactattcngtcaattcttcagactnttcgngttgtaacttatgtctcggactggaacctaagg

SEQ ID NO: 322348 - DNA, 609 bp, Homo sapiens
  misc_feature: GZ8MTXP01ECZ77.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagagccaggccaggccctgtgttgtgatatataaagacactgagaggccttcagggatccctgagcgattctctcggctcactcagggaacaatggtcacattcgaccatcagtgagtcaggcagaagacgaggctgacttattctgtccaaagttcttacaagtacctatccgtagttcggttaactttaattcgttaccgtttacgggaaacgttggggtaacccttaaagggggttcccttaaacccggttcccgttaaacgggggttacccaaccgggttaccccccgaaaacggggtacccccaaaaccccccgtacttacggttaccctaacccgtttccctttaacccccgg

SEQ ID NO: 322349 - DNA, 537 bp, Homo sapiens
  misc_feature: GZ8MTXP01EQ3A4.51.6.A06.1.454.CMB.2.raw
  modified_base (360)..(360): a, c, t, g, unknown or other
  misc_feature (360)..(360): n is a, c, g, or t
  modified_base (397)..(397): a, c, t, g, unknown or other
  misc_feature (397)..(397): n is a, c, g, or t
  modified_base (434)..(434): a, c, t, g, unknown or other
  misc_feature (434)..(434): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagccgtgggagtccctgagactctcctgtgaacgcctctggattcagcttcagttacgtattggtttgcgcgtgggtcccgccaggcctccgaggcaagggctgcgaggtgggtgcatctactatcatatgaaaagggancaaataaatactacgcagactcgtagaggccatcacntcacagacacaactcccaaagaaccactaactttacnctagacctaaagtacgaactacccgtgaacgtacgttgaacggaacacggctgttactagttattggttgacggaaggaggtaacgatacgatcaacgtaacg

SEQ ID NO: 322350 - DNA, 577 bp, Homo sapiens
  misc_feature: GZ8MTXP01BHE1C.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctccccctcctcactctctgcacaggctctgaggcctcctatgtgctgaccacacgcccaccctcggtcgtccgtcgtccccaggacagacgccaggatcacctgctctggagatgcattcgcccaacccacttattcttattcggtaccagcagaagccaggccacggcccctgtgttgtgatatataagaccactgagagccttacgagggctcccgtgacgcgtattctctcggcctccacctcgagggaccaagtcggtacactattacgaccctatacgaaggttggggacgtacccgaaggaccgaaggaaacgacggaggaccttaggtaaccttatttcctgtaacctaaattcttacaagtactaattcgagttcggttaacttagttcgttcgtacggttaacgtcgggaaccgtaaccggg

SEQ ID NO: 322351 - DNA, 490 bp, Homo sapiens
  misc_feature: GZ8MTXP01ALPB7.51.6.A06.1.454.CMB.2.raw
  modified_base (307)..(307): a, c, t, g, unknown or other
  misc_feature (307)..(307): n is a, c, g, or t
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatcccctctacttctccccctcctcactctctgcacaggctctgaggcctcctatgtgctgacacagccaccctcggtgtccgtgtccccaggacagacggccaggatcacctgctctggagatgcattgccaacccactattcttatggtaccagcagagcagcagcccctgtnttgtgatatataaagacactgagaggcttacagggaatccctgagcgattctctgctccacctcagggacaatggtcanattgaccatcagtggggatccaggcagaagagaggctagctatttntntntattntcaganattgngttagtaattatgtcgtacgttacgtaacgaacgtaag

SEQ ID NO: 322352 - DNA, 524 bp, Homo sapiens
  misc_feature: GZ8MTXP01D07HL.51.6.A06.1.454.CMB.2.raw
  modified_base (353)..(353): a, c, t, g, unknown or other
  misc_feature (353)..(353): n is a, c, g, or t
  modified_base (407)..(407): a, c, t, g, unknown or other
  misc_feature (407)..(407): n is a, c, g, or t
  modified_base (433)..(433): a, c, t, g, unknown or other
  misc_feature (433)..(433): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggaggtccctgagactctcctgtgaagcctctggattcagcttcagtacgtatggtttgcgctgggtcccgcaggctccgaggcaaggggctgcaggtgggtgcatctatatcatatagaaaaggancaaataaatactaacgcaagactccgtagaacgggccattccacatctacaganacaactcccaaagaacactactttanctagacaaatcgaaacaccctgacgtactgaggtaacacggctgttctagttattgttgacgaaggagggaagactcggatcgaacgaacg

SEQ ID NO: 322353 - DNA, 594 bp, Homo sapiens
  misc_feature: GZ8MTXP01CDKB3.51.6.A06.1.454.CMB.2.raw
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctctatgtgctgacacagccaccctggtgtccgtgtccccaggacagacgccaggactcacctgctctggagatgcattgccaacccactattcttattggtaccagcagaagccaggccaggcccctgttcgttgttgatatataaagaccactgagagcctanagggntccctgagcgattctctcggccctacgctaggacgaataggtcacatacgtacatactagtaggacggtccgaggaccgaagaagaacgaggacgtacggtacttaaactttcgttacgttctaaacttactttcgtaaacggttacctaagttcccgttaaggtttcgggttaccctttaagtttacggttccgtttacgggtaacccgttacggggtaaccggttaaaccggtttaaccccggg

SEQ ID NO: 322354 - DNA, 594 bp, Homo sapiens
  misc_feature: GZ8MTXP01BMPJJ.51.6.A06.1.454.CMB.2.raw
  modified_base (360)..(360): a, c, t, g, unknown or other
  misc_feature (360)..(360): n is a, c, g, or t
  modified_base (465)..(465): a, c, t, g, unknown or other
  misc_feature (465)..(465): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggaggcgtggtccagccgtgggagtccctgagactctctgtgagcctctggattcagcttcagttacgtagtggtttgcggtcgtcggggtccccgccgagggcctaccgagggacgaaagggggcctgcgaggtggggtgcatctatatnatatggaaaagaagctaaataaatactacgacaagtactaccggtagaacgggccgtatccaccatacctacagacactaacacccaaagaaccactaactttanacctacgaactaaatacgaaccaccctagaacgtacgttaggaacggaacctacgggcttacggttaccttaagttagttggttggacggtaaggtaggggaagtagtacggactaaccgaacgaaccg

SEQ ID NO: 322355 - DNA, 544 bp, Homo sapiens
  misc_feature: GZ8MTXP01C82L6.51.6.A06.1.454.CMB.2.raw
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtggggggaggcgtggtccagcctgggaggtccctgagactctcctgtgaagcctctggattcagcttcagtacgtatggtttgcgctgggtccgccaggctccgaggcaaggggactgcagtgggtgcatctatatcatatgaaaaggaagcaaataaatactacgcagactccgtagaacgggccgattcaccatctaccagaacgaacaaactaccccaaagaaaccaactaacttttaactctagacaaaatcgaaaccaccctagaacgtactggaacggaacacggctgttcttattattgttgacgaagagggaagatcggatcgaacgaacg

SEQ ID NO: 322356 - DNA, 533 bp, Homo sapiens
  misc_feature: GZ8MTXP01BEP88.51.6.A06.1.454.CMB.2.raw
  modified_base (155)..(155): a, c, t, g, unknown or other
  misc_feature (155)..(155): n is a, c, g, or t
  modified_base (257)..(257): a, c, t, g, unknown or other
  misc_feature (257)..(257): n is a, c, g, or t
  modified_base (297)..(297): a, c, t, g, unknown or other
  misc_feature (297)..(297): n is a, c, g, or t
  modified_base (356)..(356): a, c, t, g, unknown or other
  misc_feature (356)..(356): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttccncgttaggctctttaagaggtgtccagtgtcaggtgcagctggtacagtctgggggagcgtggtccagcctgggaggtccctgagactctcctgtgaagcctntggattcagctcagtacgtatggtttgcgtcgtgggtccnccgaggctccgagggcaaagggctggcaggtgggtgcatctatatcatatgaaggaaanacaataaactacacgcacgtacgtcgtaggacggctatcacatcacagacacacaccaanaactactacttanctanacaactacgaacacctacgacgtacgtagacggacgaacgtcgttgtcttagttagttgttggcggaggaagggagaagtacgattacaacgaacgaacg

SEQ ID NO: 322357 - DNA, 694 bp, Homo sapiens
  misc_feature: GZ8MTXP01CHYI6.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggaggtcctgagactctctgtgaagcctctggattcagcttcagtacgtatggtttgcgctgggtccgccaggctccgaggcaaggggctggcgaggtggggtgcatctatatcaagtagtaggaaaaagggtaaagctaaaattaaaactaccgtaacgacgtaacggaccttacccgggtaaggaaacggggtcccgtaagtttacccaaaccctacgttaccctacccgaaacgaacggaaaccaaaaccgttaacccccaaaagtaaacccctaacgttaaacctttttaactaccttaacgtaaactaaaacgttacggaaaaccctaccccgttagaacgtacgttacggaacggtaaccgacgggttacttcggttacctttaaagtttacgtttaggttcgggttaccgggtaaggggaacggggtaagtaacgttacggaacttccgaacgtaaccggg

SEQ ID NO: 322358 - DNA, 515 bp, Homo sapiens
  misc_feature: GZ8MTXP01D5B0T.51.6.A06.1.454.CMB.2.raw
  modified_base (353)..(353): a, c, t, g, unknown or other
  misc_feature (353)..(353): n is a, c, g, or t
  modified_base (397)..(397): a, c, t, g, unknown or other
  misc_feature (397)..(397): n is a, c, g, or t
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagcgtgggttttccgtcgttaggctcttttaagaggtgtccagtgtcaggtgcagctggtgcagtctgggggagcgtggtccagcctgggaggtccctgagactctcctgtgaagcctctggattcagcttcagtacgtatggtttgcgctgggtccgccaggctccgaggcagggactgcagtggtgcatctatatcatatgaaaggaancaaataactactacgacagactcgtagacggctatacacatacncagacacacacaanacactacttancgtanacatacgacactacgtagacgtacgagaacgacgttcgtcgttcgttattattgttgacgaaggaggaagagtacgactcgaacgaag

SEQ ID NO: 322359 - DNA, 743 bp, Homo sapiens
  misc_feature: GZ8MTXP01EIS78.51.6.A06.1.454.CMB.2.raw
  modified_base (157)..(157): a, c, t, g, unknown or other
  misc_feature (157)..(157): n is a, c, g, or t
  modified_base (253)..(253): a, c, t, g, unknown or other
  misc_feature (253)..(253): n is a, c, g, or t
tcagcgatcgtatacacgaccggtgctcgatttagatctactgacagggggtctggggagacgagcccagcactggaagtcgccggtgtttccattcggtgatcatcactgaacacagaggactcaccatggagtttgggctgagctgggttttccncgttgctcttttaagaggtgtccagtgtcaggtgcagctggtgcaggtcgtgggggaggcgtggtccagcctggggacgtccctgagctctcctgngaagcctctggattcagtcttcagttacgtagttgggtttgcgtcgtcgggtcccgccgaggcctcccgaggccgaagggggactggcgtagggtgggttcggctagtctaactattacatagtaggaaaaaggaagaactaaaataaaacgtaacgtaaccggacgtaacggtaccgttacccgggttagggaaacgggggtcccgtaacttaccgaacctaacttacccgttaacccaaagggaaacgaaaccaaaaccttaaccccgaaaaacggtaaacccctaaacccgtttaaaccgttttaaacgttacccttaacggaaacccgtaaaagttacccgaaaacctaaaccccgttaggaaaccggttacgttaacgggaacgggaaccgtaaccgggttcgttacggtttaccttaagtttaacgttgggttgaccgggtaagggaagggtaacgtagtaccggattaaccggaacaacccgg

SEQ ID NO: 322360 - DNA, 541 bp, Homo sapiens
  misc_feature: GZ8MTXP01A3WYC.51.6.A06.1.454.CMB.2.raw
  modified_base (457)..(457): a, c, t, g, unknown or other
  misc_feature (457)..(457): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtggggggagcgtggtccagcctggggagtccctgagactctcctgtgaagcctctggattcagcttcagtacgtatggtttgcgctggggtcccgccaggctccgaggcaaggggactggcaggtggggtgcatctatatcgatagtaggaaaaggaagcaaataaatactacggcagactaccgtgaagggccgattcaccatctaccagagaacaactacccaaagaaccacaactttatctagacaaatnaaacctaccctgaacgacttggaaggaacacgggctgttactattaattgttgcggaagagggaagagtacggatcaacgaacg

SEQ ID NO: 322361 - DNA, 832 bp, Homo sapiens
  misc_feature: GZ8MTXP01CE5YF.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgctctttaagaggtgtccagtgtcaggtgcagctggtgcagtcgtgggggagcgtggtccagccgtgggagtccctgagactctcctgtagacgcctcgtggattcagcttcgagttacgtagttgggtttcgccggtcgttcgggggtccccaccgaacggggtcccttccccggaagggggtaccgaaaaggggggtccttgggccgtaagggggttggggggttacggcctaaagtttccgttaaacgttaccgttaacgtaaagttaaggtaaacggggaaaaaaaagggtaaactaactaaaacgttaaaaacgttaaaccgtaaccggtaaccgtaacggtaaccggtaacccgggtaacgggtaaaccggggtaaccggtaaccgttaaccgtaacccgtaaccgtaccgtaaccgtaacggaaacgaaaccgtaaaccgtaaacccgtaaaaccgtaaaccgtaaaccgttaaactttaaacgttaaccgtaacgtaaaccgtaaacgtaaaccgtaaaccgtaaacccgtaacgtaaacgtaacgttaacggtaacggtaaccggtaaccggttacgttacgttacgttaacgtttacgttacggttcggttacggtaagggtaagggtaacggtaacgtacgttacgtaaccgaacgtaacg

SEQ ID NO: 322362 - DNA, 574 bp, Homo sapiens
  misc_feature: GZ8MTXP01EOBEY.51.6.A06.1.454.CMB.2.raw
  modified_base (218)..(218): a, c, t, g, unknown or other
  misc_feature (218)..(218): n is a, c, g, or t
  modified_base (444)..(444): a, c, t, g, unknown or other
  misc_feature (444)..(444): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattcgaccaacccattattcttattggtacagcagaagccaggccaggccctgtgtgtgatatataaagacactgagaggccttcgagggactcccgtgagcgtattccctcgtggcctcccacctacgaagggaacaaagtggtacactattcgaccatcgagtggacgtccaggacaaggaagacgaggctagacttatttctaggtactaaattcttanagcatcaagttgtactttagtcgttcttaacggtaacgttcgggaaccttaagggtcctaacccggttcgttacggttccaaccggacccctaaacggccccaaaccccgaccttccgttccgtaacccg

SEQ ID NO: 322363 - DNA, 518 bp, Homo sapiens
  misc_feature: GZ8MTXP01EPCG6.51.6.A06.1.454.CMB.2.raw
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (452)..(452): a, c, t, g, unknown or other
  misc_feature (452)..(452): n is a, c, g, or t
  modified_base (473)..(473): a, c, t, g, unknown or other
  misc_feature (473)..(473): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccatattcttattggtaccagcagagccaggccaggcccctgtgttgtgatatataaagacactgagaggcccttacgagggntccctgagcgtattcncgtggcctccacctcgaagggacaaagtcggtacacattcgaccatcagtgggacgtccgaggcagaagcgaggctgtactattcngtcaattctcagactattcgngttggtaacttagtgttcttacgggaactcgggaacccgtaacgg

SEQ ID NO: 322364 - DNA, 522 bp, Homo sapiens
  misc_feature: GZ8MTXP01BU5OS.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattctattggtaccagcagaagccaggccaggcccctgtgttgttgatatataaagacactgagaggccttacgagggtaactccccgtgacgtcgtatttcgtctgggcctccacctcgagggacaagtggtacacattgaccatcagtgggagtccgagcagaagcgaggctgacttattctgtctaattcttacagtacattcagttcggtaacttatgttactcgggttaactgggaacctaacggg

SEQ ID NO: 322365 - DNA, 636 bp, Homo sapiens
  misc_feature: GZ8MTXP01CJ9AN.51.6.A06.1.454.CMB.2.raw
  modified_base (300)..(300): a, c, t, g, unknown or other
  misc_feature (300)..(300): n is a, c, g, or t
  modified_base (513)..(513): a, c, t, g, unknown or other
  misc_feature (513)..(513): n is a, c, g, or t
  modified_base (577)..(577): a, c, t, g, unknown or other
  misc_feature (577)..(577): n is a, c, g, or t
  modified_base (585)..(585): a, c, t, g, unknown or other
  misc_feature (585)..(585): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcaggtcgtgggggagcgtggtccagccgtgggacgtccctgagactctctgtgacgcctctggattcagcttcagtacgtatggtttgcgtcgtgggtccnccgtaggctcgaggcgaagggctgcgaggtggggtcgcagttctaagtatacaattagtaggaaaaaagggaaactaacaaaaattaaaacgtaccgttaacgactaacgggtaacctacccgggtaggaaacggggtccgtaattaccaacctatccgtaccaagaacgaaaccaaactaccccgaaataaacctaacgttaacttttaacnccgttaacgaactaaactacgaaaccacccgtaggaactacgttagggaagaaccgtacggttnttacgttnttaagttgttggttgacggaagggagggaagtatcggaactcgaacgaacg

SEQ ID NO: 322366 - DNA, 563 bp, Homo sapiens
  misc_feature: GZ8MTXP01BU07Y.51.6.A06.1.454.CMB.2.raw
  modified_base (298)..(298): a, c, t, g, unknown or other
  misc_feature (298)..(298): n is a, c, g, or t
  modified_base (460)..(460): a, c, t, g, unknown or other
  misc_feature (460)..(460): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtgcagtcgtgggggaggcgtggtccagcctgggaggtccctgagactctcctgtgaagcctctggattcagcttcagtacgtatggtttgcgctgggtccnccaggctccgaggcaagggctgcaggtgggtgcatctatatcatataggaaaaggaagcaaataaatactacgcaaggtactaccgtaggaacgggccgtaattccaaccattacccaccaagacgaacaaactacccaaagaaacccacgtaacttttaancctagacctaaatcaaacaacccgtgaacgaccttggacgaacacgggctagttacgttattagttagttgacggaaggagggaagtacgtgactccgaagcg

SEQ ID NO: 322367 - DNA, 487 bp, Homo sapiens
  misc_feature: GZ8MTXP01CMIZN.51.6.A06.1.454.CMB.2.raw
  modified_base (406)..(406): a, c, t, g, unknown or other
  misc_feature (406)..(406): n is a, c, g, or t
  modified_base (457)..(457): a, c, t, g, unknown or other
  misc_feature (457)..(457): n is a, c, g, or t
  modified_base (473)..(473): a, c, t, g, unknown or other
  misc_feature (473)..(473): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagaggcttcagggatccctgagcgattctctcggctcactcagggaacaatggtcacattgaccatcagtgagtccaggcagaagacgaggctgactattctgtcaattcttnagacatcagtggtacttatgtctcggactgggacaggtcacgtctagttcngcccaaggcccaaccntgcaacttcgtccg

SEQ ID NO: 322368 - DNA, 553 bp, Homo sapiens
  misc_feature: GZ8MTXP01DY9S0.51.6.A06.1.454.CMB.2.raw
  modified_base (298)..(298): a, c, t, g, unknown or other
  misc_feature (298)..(298): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggaggtccctgagactctcctgtgaagcctctggattcagcttcagtacgtatggtttgcgctgggtccnccgaggctccgaggcaagggggactggcgaggtgggtgcatctatatnatatgaaaaggaancaaataaatactacgcaagactcgtagaggccgattcaccatctaccagacgacaactaccaaagaacactaactttatactagaaccaaatcgaaacctaaccccgtgaacgtacttaggacggaactacggcttgttactatttaagttggttgacggtaaggaagggtaagagtcggataacaacgaacg

SEQ ID NO: 322369 - DNA, 587 bp, Homo sapiens
  misc_feature: GZ8MTXP01EXHIT.51.6.A06.1.454.CMB.2.raw
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagttttgggctgagcgtggttttcgcgttaggctctttaagaggtgtccagtgtcaggtgcagctggtgcagtcgtgggggagcgtggtccagcctggggaggtccctgagactctcctgtgaagcctgnggtntcngctctagtagtagtgttgcgtcgtcggtccgcgcgcgtcgacgacgacggacgtgcgtggtggtgctatctactatatatagtagaaagaagaactaaataaactaacgtacgacgtacgtacgtacggtacggtaacggtacgtactacaccactactaccgacgaacgaacaaccaaccaaacaacaacgttaacttacttactacgaacaaacgtaacgaacctaaccgtacgtagtacgtacgacggaacgtacgttcgtcgttacgttagttagttgttgaggaaggaggaagagtacgactaacgaacgaacg

SEQ ID NO: 322370 - DNA, 496 bp, Homo sapiens
  misc_feature: GZ8MTXP01A3MJR.51.6.A06.1.454.CMB.2.raw
  modified_base (460)..(460): a, c, t, g, unknown or other
  misc_feature (460)..(460): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaaagacactgagaggccttcagggatccctgagcgattctctggctcactcaggaacaatggtcacattgaccatcagtgagtccaggcagaagacgaggctgactattctgtcaatcttcagacatcagtggtacttatgtcttcggaatggaccaaggtcacgtctaggttcngcccaaggcccaacccgctcgttactaacttctccg

SEQ ID NO: 322371 - DNA, 597 bp, Homo sapiens
  misc_feature: GZ8MTXP01DRBNT.51.6.A06.1.454.CMB.2.raw
  modified_base (595)..(597): a, c, t, g, unknown or other
  misc_feature (595)..(597): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttcgtcgtagcgtctttaagaggtgtcagtgtcaggtgcagctggtgcagtcgtgggggaggcgtggtccagccgtgggaggtccctgagactctctgtgaagcctgtggattcagtcttcgagttaacgtgttgggtttgcggtcgtcggggtcccgccgtagggcctacccgaaaggcgaaacgggggacctggaccgagggttgggggtggacctaaagttccttaactattacgaaattaagttacgggaaaaaaagggtaaaacgtaaccgtaaaaattaaaaccgttaaaccggtaaaccgaacgtaacgggtaacccgttacccgggtaacggggaaaccgggtacccttaacgttaccccgaaacccgttaacgttaccccgtaaaccgaaacggtaaacgaaaacccgtaaaacccgtaaaccccgtaaaaccgtnnn

SEQ ID NO: 322372 - DNA, 559 bp, Homo sapiens
  misc_feature: GZ8MTXP01CN7MV.51.6.A06.1.454.CMB.2.raw
  modified_base (295)..(295): a, c, t, g, unknown or other
  misc_feature (295)..(295): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (418)..(418): a, c, t, g, unknown or other
  misc_feature (418)..(418): n is a, c, g, or t
  modified_base (432)..(432): a, c, t, g, unknown or other
  misc_feature (432)..(432): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgaagcctctggattcagcttcagtacgtatggtttgcgctgggtccnccgaggcctccgaggcaaaggggctggcgaggtgggtgcatctatancatatgaaaaggaanaacaaataaatacacgacaagactcgagacggcatcacatacacagacaacaacaccaaanaaccactactttanctagaacaaatcgaaacctaccgtagtaacgtacgttaggaacggtaaccgacggttctacgttacttaagttagttcggttggacgggaaggaggggtaagtacgtacgaactaaccgaacgaacg

SEQ ID NO: 322373 - DNA, 557 bp, Homo sapiens
  misc_feature: GZ8MTXP01CEBND.51.6.A06.1.454.CMB.2.raw
  modified_base (257)..(257): a, c, t, g, unknown or other
  misc_feature (257)..(257): n is a, c, g, or t
  modified_base (297)..(297): a, c, t, g, unknown or other
  misc_feature (297)..(297): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (542)..(542): a, c, t, g, unknown or other
  misc_feature (542)..(542): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtgcagtcgtgggggagcgtggtccagcctggggagtccctgagactctctgtgaagcctntggattcagcttcagtacgtatggtttgcgctgggtcccncgaggctccaggcaaggggctgcgaggtgggtgcatctatatnattanagaaaagaagcaaataaataactacgacacgactacccgtagaacggacggacttacaccactactaccaagacgaacaaactaaccaaacgaaacaactaactttacttacttacgaccaaattaacgaaacaacccaccgtagaccgttagaggaacgacgacgtcgttagtattattgttgagaagaggaaganagactaacgaagaag

SEQ ID NO: 322374 - DNA, 660 bp, Homo sapiens
  misc_feature: GZ8MTXP01CP7RJ.51.6.A06.1.454.CMB.2.raw
  modified_base (214)..(214): a, c, t, g, unknown or other
  misc_feature (214)..(214): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctcgtgganatgctattcgacccaaaccctacttattcttagttcggtaccagcaagaacgccgaggccacggtccctgtgttgtgaattaataataaacgactacgtggaaggacggtccttacggagggtacttcccgtaggacgcgttattcctcgtccggtcctacctacctacggaacggggaaactaaacgttcgggtacctaaaccgtaagtttccgaaaccctagttacgagggttagggtacgtacccgagggacaaaggaaaggaccggaaggtctacgtacttacttctgttacaaattcttacgaagacctatcgagttaggttaactttagtcgttacttacgggggtaactaacgggaaccgaaaggttccgaccgttaccgtcggttacgcgaccccgaacggacccaaccccacgtcgacctaaccgttcgttaacccg

SEQ ID NO: 322375 - DNA, 490 bp, Homo sapiens
  misc_feature: GZ8MTXP01D5TXQ.51.6.A06.1.454.CMB.2.raw
  modified_base (407)..(407): a, c, t, g, unknown or other
  misc_feature (407)..(407): n is a, c, g, or t
  modified_base (456)..(456): a, c, t, g, unknown or other
  misc_feature (456)..(456): n is a, c, g, or t
  modified_base (473)..(473): a, c, t, g, unknown or other
  misc_feature (473)..(473): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaacccatattcttattggtaccagcagaagccaggccaggcccctgtgttgttgatatataaagacactgagaggcttcagggatccctgagcgattctctcggctcactcaggaacaatggtcacattgacatcagtgagtccaggcagagacgaggctgactattctgtcaatcttcganacatcagtggtacttatgtctggaactggacaggtcacgtctaggttcncgcccaaggccaacccnctcgctaacttcttccg

SEQ ID NO: 322376 - DNA, 592 bp, Homo sapiens
  misc_feature: GZ8MTXP01A7BJD.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggaggcgtggtccagccgtggggaggtccctgagactctcctgtgaacgcctctggattcagcttcagtacgtatgggtttgcgcgtgggtcccgccgaggcctccgagggcaagggggactggcaggtggggtggcagtctatatcaatataggaaaaggaagcaaataaatactacgacagactccgtagaaggcatcacatctccagacgacaactacccaaagaacactactttatacctagaccaaatcgaaacctaccccgtagaacgtaccttaggaacggaacgtaccgggttcttacggttaccttaagtttaagttggttggaccgggtaagggaaggggtaagtacgtaccggttaattccgaacgaaccgg

SEQ ID NO: 322377 - DNA, 561 bp, Homo sapiens
  misc_feature: GZ8MTXP01C8672.51.6.A06.1.454.CMB.2.raw
  modified_base (464)..(464): a, c, t, g, unknown or other
  misc_feature (464)..(464): n is a, c, g, or t
  modified_base (497)..(497): a, c, t, g, unknown or other
  misc_feature (497)..(497): n is a, c, g, or t
  modified_base (505)..(505): a, c, t, g, unknown or other
  misc_feature (505)..(505): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctccccctcctcactctctgcacaggctctgaggcctcctatgtgctgacacagcccaccctcggtgtccgtcgtccccaggacagacggccaggatcacctgctctggagatgcattcgcccaaacccactattcttattggtaccagcagaagccaggccacggcccctgtgtgttgatatataaagaccactagagagtccttaacgagggtctcccgtgaacgcgacttctcgtcggcctccacctcgagggacaaagtggtacactagttcgacctatacgaaggtggggacgtccgaaggacaaggaagacgnggtactgtaacttattctgtctaaattccttanagtaactnttacgagttaggttaacttatcgttacgtacgggaacttcgggaaccgttaacggg

SEQ ID NO: 322378 - DNA, 504 bp, Homo sapiens
  misc_feature: GZ8MTXP01ESU5Q.51.6.A06.1.454.CMB.2.raw
  modified_base (296)..(296): a, c, t, g, unknown or other
  misc_feature (296)..(296): n is a, c, g, or t
  modified_base (384)..(384): a, c, t, g, unknown or other
  misc_feature (384)..(384): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgtgatatataaagacactgagnggccttcagggatccctgagcgattctctcggctcacctcagggaacaatggtcacattgaccatcagtgagtccaggcagaagacgnggctgactattctgtcaagtcttacagacatcagtgtacttatgtctcggaatgggaccagggtcaccggtcctgttacgngccccaaggcccaaccccnctcgttccaacgttctcccg

SEQ ID NO: 322379 - DNA, 576 bp, Homo sapiens
  misc_feature: GZ8MTXP01DJ48F.51.6.A06.1.454.CMB.2.raw
  modified_base (362)..(362): a, c, t, g, unknown or other
  misc_feature (362)..(362): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtggggggaggcgtggtccagccgtgggaggtccctgagactctcctgtgaagcctctggattcagcttcagtacgtatggtttgcgcgtgggtcccgccgaggctccgaggcaaggggctgcaggtgggtgcatctatatcatagtagaaaaggaancaaataaatactacgcagactcgtagaaggcgatcacatctaccagagacaactacccaaagaacactaactttatctagacaaatcgaaaccaccctgaacgtacgttaggaacgggaaccaacgggttcttacggttcttaaagtttagtttagggttggaccgggtaagggaagggggtaacgtaagttccggaattccgaacgtaaccgg

SEQ ID NO: 322380 - DNA, 519 bp, Homo sapiens
  misc_feature: GZ8MTXP01DEWB6.51.6.A06.1.454.CMB.2.raw
  modified_base (422)..(422): a, c, t, g, unknown or other
  misc_feature (422)..(422): n is a, c, g, or t
  modified_base (440)..(440): a, c, t, g, unknown or other
  misc_feature (440)..(440): n is a, c, g, or t
  modified_base (476)..(476): a, c, t, g, unknown or other
  misc_feature (476)..(476): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacgaccaggatcacctgctctggagatgcattgcccaacccacttattcttatggtaccagcagaagccaggccaggcccctgtgttgtgatatataaagacactgagaggccttgagggactccctgagcgtattctctcggcctccactcgagggaacaaatggtcactattgaccatcagtggagtccgaggcaaggaagacgaggctgacttattctgtacattcttnaagacatcgagtgtactntgtctcggactgggacaaggtcacgtcgtggttacncggacccaaggaccccaaccgtctacgttctaacgttctcccg

SEQ ID NO: 322381 - DNA, 490 bp, Homo sapiens
  misc_feature: GZ8MTXP01AF75M.51.6.A06.1.454.CMB.2.raw
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctgggagatgcattcgccaacccactattcttattggtaccagcagaagccaggccaggcccctgtgttgttgatatataaagacactgagaggccttcgagggatcccgtgagcgattctctcggctcactcaggaacaatgcacattgacatcagtggagtcaggcagaagacgaggctgactatttcngtacaatcttnagacatcagtggtactntgtctcgatggacagtcacgtctaggttcgcgcccgaagcccaacccntcgcncttcgtcccg

SEQ ID NO: 322382 - DNA, 673 bp, Homo sapiens
  misc_feature: GZ8MTXP01EQQIA.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattcgcccaaacccacttattcttattcggtaccagcagaagccaggccaggcccctgtgttgtgatatataaagacactgagaggtcttcgagggactcccgtgagcgattctctcggctccacctcgacgggaacaaagtggtacactattcgaacctatacgtaggtacgggagtacccgagggacaaaggaaaggaacggagggtactaggtaacttatttctagttactaaacggttcttacaacgactatacgtaggttagttaacctttaagttcggttaccgttacgggtaaacgtcggggtaaacccgttaaacgggttacccgttaacccggttaccgttaaccggggttaccgaaccgggttacccccgtaaaccggggaccccctaaaaccccctaaccggttccggttaccccgtaacctttccccgtttaacccccggg

SEQ ID NO: 322383 - DNA, 579 bp, Homo sapiens
  misc_feature: GZ8MTXP01AZT26.51.6.A06.1.454.CMB.2.raw
  modified_base (367)..(367): a, c, t, g, unknown or other
  misc_feature (367)..(367): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggacgtccctgagactctctgtgagcctctggattcagcttcagttacgtatgggtttgcgtcgtggggtcccgccgaggcctccgaggcgaaaggggctggcgaggtgggtgcagtctatatcatataggaaaaaggganaacaaataaacactaacgcaagactccgtagaaggccatcacatctcagacaacaactacccaaagaaccacgtaactttacacttacgaacaaactcgaaacccacccgttagaacgtaaccttggaacgggaaccaacgggcttacggttcctaaagtttagttcgttggacggaagggaggggaatagtaccggaattccaacgaaccg

SEQ ID NO: 322384 - DNA, 590 bp, Homo sapiens
  misc_feature: GZ8MTXP01C5A9V.51.6.A06.1.454.CMB.2.raw
  modified_base (301)..(301): a, c, t, g, unknown or other
  misc_feature (301)..(301): n is a, c, g, or t
  modified_base (367)..(367): a, c, t, g, unknown or other
  misc_feature (367)..(367): n is a, c, g, or t
  modified_base (551)..(551): a, c, t, g, unknown or other
  misc_feature (551)..(551): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtggggggagcgtggtccagcctgggagtccctgagactctcctgtgaagcctctggattcagcttcagttacgtatgggtttgcgtcgtgggtccnccgaggctccgaggcaaggggctggcaggtgggtgcatctaagtatacatagtggaaaaagggaanctaaaataaatacgtacgcaagtacctcggtagaacgggcccaattccaacctatactccgaagacgacaaaactcccgaaaagaaccactaccttttagacctagaacctaaaagtcgaaacctacccgttaggaacgtaccttaggaagggtaacccacgggttcttagttcttaaagtttnttaggttgacgaaggagggcaatccgaatcgaacgaacg

SEQ ID NO: 322385 - DNA, 589 bp, Homo sapiens
  misc_feature: GZ8MTXP01DFTJ7.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctcctatgtgctgacacagccacctggtgtccgtgtccccaggacagacggccaggatcacctgctctggagatgcattcgacccaaccacttattcttattcggtaccagcagaacgccaggccacggcccctgtcgttgttagataatataaagaccactagagacgccttacgaggtctcctgacgctattctctcgtcctaccactcgaggaacagtcggtacactatacgacctatacgaggtcggggacgtacccgaaggacgaaaggaaacggtaacggaggtacctaggtaactttacgtttcgtgtaactaaacttcttaacagtaactacgttacgttagttacggttaacttacttcggttacggttacggaacgttaacggggaaccgttaaaccgggg

SEQ ID NO: 322386 - DNA, 498 bp, Homo sapiens
  misc_feature: GZ8MTXP01C6JPN.51.6.A06.1.454.CMB.2.raw
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccactattcttattggtaccagcagagcagcaggccctgtgtgtgatatataaagacactgagaggccttcagggactccctgagcgattctctcggctccactcagggaacaatggtcacattgaccatcagtgagtccaggcagaagacgaggctgacttattctgtcaagtcttcaagacatcgagttggtacttatgtcttggaactgggacaaggtccacgtcctggttcngcccaaggcccaacccgactnttccaacttcgtccc

SEQ ID NO: 322387 - DNA, 755 bp, Homo sapiens
  misc_feature: GZ8MTXP01EGIBH.51.6.A06.1.454.CMB.2.raw
  modified_base (215)..(215): a, c, t, g, unknown or other
  misc_feature (215)..(215): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgactacagccaccctcggtgtccgtgtccccaggacagacggccaggatcacctgctctgganatgcattgcccaaaccatattcttattggtaccagcagaagccaggccaggccctgtgttgtgatataataaagacactgagaggccttacgagggactcccgtgagtcgtattctcgtcggcctaccacctacgagggaaaccaaagttcgggtaccaaactagtttacgaaccctaagtccgaaggttacgggacgtacccgaagggaccaaaggaaacggtaaccgaagggtctaggtacttaacgtttctacgtactaaagtttccttacgaaacgtaacctaagttacccgtaagggtttacgggtttaaaccctttaagttaccggtttaccggtttaacccggggtaaacggttaaccgggggtaaaccccgttaaacgggggtttacccccttaaacccggtttaccccggttaaacggggttaccccgttaacccggttaacccccggtaaaaccgggacccccctaaaaccccccgttaacccgttccgggttaccccgttaacccctttccccggttttcccccccggg

SEQ ID NO: 322388 - DNA, 590 bp, Homo sapiens
  misc_feature: GZ8MTXP01D0GDO.51.6.A06.1.454.CMB.2.raw
  modified_base (432)..(432): a, c, t, g, unknown or other
  misc_feature (432)..(432): n is a, c, g, or t
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagccaccctcggtgtccgtgtccccaggacagacggccaggatcacctgctctggagatgcattcgacccaaaccctacttattcttattcggtaccagcagaagccaggccaggcccctgtgttgtgatatataaagacactgagaggtcttcgagggactccctgagcgtattctcgtcggcctccacctcgaacgggaacaatggtacaactagttacgacccatcgaaggtggacgtcgaggacaaggaagacggagctagacttattntagtactaagtcttacagtacatcagtggttacttagtgtcgttacggacgtcgggaacttaaggtccttaccgtaccgttaagggttaccaccgaacccgtaaccgggacccctaaaccccgtacgtccggttaccctaacctttccgttcccccgg

SEQ ID NO: 322389 - DNA, 563 bp, Homo sapiens
  misc_feature: GZ8MTXP01COM90.51.6.A06.1.454.CMB.2.raw
  modified_base (260)..(260): a, c, t, g, unknown or other
  misc_feature (260)..(260): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (450)..(450): a, c, t, g, unknown or other
  misc_feature (450)..(450): n is a, c, g, or t
  modified_base (546)..(546): a, c, t, g, unknown or other
  misc_feature (546)..(546): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccagcctggggaggtccctgagactctcctgtgagcctntggattcagcttcagtacgtatggttgcgctgggtccgccaggctccgaggcaaggggctggcaggtgggtgcatctatatnatanggaaaaggaancaaataaacactacgcaagactccggtaggaacgggccattaccaccatctaccagacgaacaaactacccaaagaaccacgtaacttttaanctagacctaaaatcgaaacaccctgaacgtacgttaggaacggaacctacgggttcttagttcttaatttgttggttgacggtaaggaggggtaanagtcgatccgaacgtcg

SEQ ID NO: 322390 - DNA, 512 bp, Homo sapiens
  misc_feature: GZ8MTXP01EFDDA.51.6.A06.1.454.CMB.2.raw
  modified_base (474)..(474): a, c, t, g, unknown or other
  misc_feature (474)..(474): n is a, c, g, or t
  modified_base (498)..(498): a, c, t, g, unknown or other
  misc_feature (498)..(498): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctggggtttttcctcgttgctctttttaagaggtgtccagtgtcaggtgcagctggtgcagtcgtgggggaggcgtggtccagcctgggaggtccctgagactctcctgtgaagcctctggattcagctcagtacgtatggtttgcgctgggtccgccaggctccgaggcaagggactgcaggtgggtgcagtctatatcatatggaaaagaagcaaataaatactacgcagactccgtagaggcgatcacatctccagagacaactacccaaagaaccactactttatctagacaaatcgaacaccctgagacttgagcacggctgttntattattgttgacgaagagggaanatgatcgaacaacg

SEQ ID NO: 322391 - DNA, 609 bp, Homo sapiens
  misc_feature: GZ8MTXP01D6O5R.51.6.A06.1.454.CMB.2.raw
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttatggtaccagcagagccaggccaggcccctgtgttgttgatatataaagacactgagaggcctttcgaggggtcctcgtagcgatntctggtccncctacctacgacggacgaaactaggtcgactattagtacactacgtagtaggagtaccaggacgagaaagaacggaaggacgtagtacgtaattacgttacgtactaacttacgttactaacgtaactactacgtacgttaggttaacgtttagttcgttacgttacggttaaccggtacgggtaaccggtaacggttacgtaccgttaccgtacggtacgacgcccgaaccgaacccaacccgtaacctcgtacttacctccgttccgtccccg

SEQ ID NO: 322392 - DNA, 698 bp, Homo sapiens
  misc_feature: GZ8MTXP01E2WJG.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtgggggagcgtggtccagccgtgggacgtcctgagctctctgtgacgctctggattcagcttcagtacgtatggttgcgtcgtcgggtcccgccgaggcctccgaggcgaaagggggtctggcgtagggtggggtcgactattctaatatacaagtaagtaggaaaaaagggaataactaaaataaaactaccgtaacgacgtaacggaaccgttacccgggtaggaaacggggtaccctaattaccgaaccctagtaccctaccgaaaggaacgaaacaaaccgtaaccccaaaagaaaccctaacgttaaccttttaataccgtaacgaaacctaaaaacgttaccggaaaaccctaaccccgttaggaaaccgtaaccgttagggaaacggtaaccgtaacggggttccttaggttacttaaacgtttaagttgggttcggacgggtaaggtaggggaagtacttacggaacttcccgaacggtaaccg

SEQ ID NO: 322393 - DNA, 548 bp, Homo sapiens
  misc_feature: GZ8MTXP01DD94O.51.6.A06.1.454.CMB.2.raw
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgaccaaccctactattcttattcggtaccagcagaagccaggccaggcccctgtgttgtgatatataaagacactgagaggccttcaggggactcccgtgagcgtattctctcggctccacctcagggaacaatggtacacattcgaccatcagtgagtccgaggcagaaagacgaggntgacttattcagtcaagttcttananacatcgtagttagttacttgtcgtacgtacggaacgtaacgggaacgttacggtccgaccgtcgtacggccgacgacccgaaccgaccccaacccgtctcgttacctccgttccgtcccg

SEQ ID NO: 322394 - DNA, 499 bp, Homo sapiens
  misc_feature: GZ8MTXP01D7BV8.51.6.A06.1.454.CMB.2.raw
  modified_base (442)..(442): a, c, t, g, unknown or other
  misc_feature (442)..(442): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgcccaacccactattcttattggtaccagcagaagccaggccaggcccctgtgttgttgatatataaagacactgagaggcctttcagggatccctgagcgattcctctggctccacctcagggcaatgtcacattgaccatcagtggagtccaggcaagaaagacgaggctgactatttctgtcaaatcttcagacatcaagtggtacttatgtntcggaattgggaccaaaggtcacgttcagttcaagccaaggccacccactgttcaac

SEQ ID NO: 322395 - DNA, 546 bp, Homo sapiens
  misc_feature: GZ8MTXP01CJEN1.51.6.A06.1.454.CMB.2.raw
  modified_base (208)..(208): a, c, t, g, unknown or other
  misc_feature (208)..(208): n is a, c, g, or t
  modified_base (391)..(391): a, c, t, g, unknown or other
  misc_feature (391)..(391): n is a, c, g, or t
  modified_base (524)..(524): a, c, t, g, unknown or other
  misc_feature (524)..(524): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggcaggatcacctgctntggagatgcattgaccaaacccatattcttattggtaccagcagaagccagccagccctgtgtgtgatatataaagacactgagaggccttacgagggtactcccgtgacgcgtattcgtctcggcctccaccgtcgaagggaaaccaaagtggtacaactattacgaaccatcgaagtgganccgaaggcaagaagacgaggctagacttattctgtacaagtcttacagtacatcgagtggtactagtgttctcggaaactgggaaccttagggtacaccgtaccgtagttcgcgaccccaaggacccaacccntccgttactaaccgttctcccg

SEQ ID NO: 322396 - DNA, 555 bp, Homo sapiens
  misc_feature: GZ8MTXP01DZAZI.51.6.A06.1.454.CMB.2.raw
  modified_base (324)..(324): a, c, t, g, unknown or other
  misc_feature (324)..(324): n is a, c, g, or t
  modified_base (475)..(475): a, c, t, g, unknown or other
  misc_feature (475)..(475): n is a, c, g, or t
  modified_base (496)..(496): a, c, t, g, unknown or other
  misc_feature (496)..(496): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtcccccaggacagacgccaggatcacctgctctggagatgcattcgacccaaacccactattcttattggtaccagcagagccaggccaggcccctgtgttgtgatanataagaccactagagagtccttacgagggaatccctgacgcgtattctcgtcggctccacctcagggacaaagtcggtactacattcgaccataccgaggttcggacgtccgaaggaccaaggaagccgaggtctagtacctttattcgtntaactaacttcttcagacctnttacgagttcggttaactttagtcgttcgttacggaacttcgggaacccgttaaccggg

SEQ ID NO: 322397 - DNA, 604 bp, Homo sapiens
  misc_feature: GZ8MTXP01CAKD5.51.6.A06.1.454.CMB.2.raw
  modified_base (436)..(436): a, c, t, g, unknown or other
  misc_feature (436)..(436): n is a, c, g, or t
tcagcgatcgtatacacgaccggtgctcgatttagatctactgacaggggtctgggagacgagcccagcattggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggaggtccctgagactctcctgtgaacgcctctggattcagcttcagtacgtagtggtttgcgctgggtcccgcaggctccgaggcaaggggctgcaggtgggtggcagtctaatatcaagtatagaaaaaggaagcaaataaactactacgacaagactccgtagaacgggccattcacatccgtacaagagacaataccccaaaanaacctacttacttacactacgaactaaagtaccgaaacctaccgtagtaacgtacgttacggaacggtaaccgtacggttcttacgttacgtttaagtttacgttagggttacggacggtaaggggtaacgggtaacgtaacggtaccgacgtaaccgaacggtaacg

SEQ ID NO: 322398 - DNA, 594 bp, Homo sapiens
  misc_feature: GZ8MTXP01AEFOE.51.6.A06.1.454.CMB.2.raw
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgctctttaagaggtgtccagtgtcaggtgcagctggtgcaggtcgtggggggagcgtggtccagccgtggggaggtccctgagactctcctgtgagcctctggattcagcttcagttacgtatggtttgcgtcgtgggtccncaggcctccgaggcaagggctggcaggtgggtgcatctatatcatagtagaaaagggaanaactaaataaatacgtaacgcaacgtacgtacggtaggaacggcctaatccacctatacctacgaagacgaactaactaccaaagaacctacgtaacttagtactacgaactaaagtcgaacctaccgtagtaacgtacgttacggaacggtaacctacggttcttagttacgttaagtttgttcggcggacggaagggtagggaactacgtacgactaaccgaacgtaacg

SEQ ID NO: 322399 - DNA, 712 bp, Homo sapiens
  misc_feature: GZ8MTXP01EVF5S.51.6.A06.1.454.CMB.2.raw
  modified_base (312)..(312): a, c, t, g, unknown or other
  misc_feature (312)..(312): n is a, c, g, or t
  modified_base (674)..(674): a, c, t, g, unknown or other
  misc_feature (674)..(674): n is a, c, g, or t
tcagcgatcgtatacacgaccggtgctcgatttagatctactgacaggggtctgggagacgagcccagcattggaagtcgccggtgtttccattcggtgatcatcactgaacacagaggactcaccatggagtttgggctgagcttgggtttttcctcgttgcttcttttaagaggtgtccagtgtcaggtgcagctggtgcagtcgtgggggagcgtggtccagccgtgggacgtcctgacgactctcctgtagaagcctctggattcagcttacagttacgtagttggtttcgccgtcgtcggggtcccnccgaggcctaccgaggacgaaagggggctggcgtagggtgggtgactagtcttaatatacaagtacgtaggaaaaaagggaactaactaaaaattaaaacgtaccgtaaaccgacgaaacggtaccgttaacccgggtagggaaaccggggtacctaacttaccaacccgtaagttaccctaacccgaagaaacgaaacccaaaaccttaacccccgaaaaagtaaccctaaacgttaaacctttttaaacgtacccttaacggaaacctaaaacgttaccgtaaaacccaaccccgttaggaaaccgttaccgttagggaacggaaccgtacggttcttagttacttaagtttagttcggnggacggtaaggagggtaagtactacggatccgaagccg

SEQ ID NO: 322400 - DNA, 546 bp, Homo sapiens
  misc_feature: GZ8MTXP01CQZJB.51.6.A06.1.454.CMB.2.raw
  modified_base (305)..(305): a, c, t, g, unknown or other
  misc_feature (305)..(305): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaacccattattcttattggtaccagcagaagccagccaggcccctgtgtgttgatatataaagacactgagaggccttnagggactcctgagcgattctctcggcctcacctcgaggaacaagtcggtacactattcgaaccatcgagtggagtccgaggcaagaagacgagctagacttatttctagtacaattcttacgaagacatcaggttgttaacttatgttacgttggaactgggaaccaggttccgaccgttacgtaggttaccgcgttacccaacggcccaaccccatcgttacctaacgttcgtttccccg

SEQ ID NO: 322401 - DNA, 580 bp, Homo sapiens
  misc_feature: GZ8MTXP01BPXHM.51.6.A06.1.454.CMB.2.raw
  modified_base (409)..(409): a, c, t, g, unknown or other
  misc_feature (409)..(409): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtacagcagaagccaggccaggcccctgtgttgtgatatataaagacactgagaggccttcgagggatccctgagcgattctctggctcactcagggaacatggtacacattgaccatcagtggagtccaggcagaagacgaggctgactattctagtcaagtcttnagactatctagtggttacttagtcgttacgttcggtaaacgtcgggtaacccaaagggtccttaaacccggttcccgttaacgggttcccgaaaccgggcccccgaaaacggggtccccccaaaacccccggtcttaccgggttaccctaacccttcccgtttaacccccg

SEQ ID NO: 322402 - DNA, 520 bp, Homo sapiens
  misc_feature: GZ8MTXP01CD72Z.51.6.A06.1.454.CMB.2.raw
  modified_base (260)..(260): a, c, t, g, unknown or other
  misc_feature (260)..(260): n is a, c, g, or t
  modified_base (300)..(300): a, c, t, g, unknown or other
  misc_feature (300)..(300): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (401)..(401): a, c, t, g, unknown or other
  misc_feature (401)..(401): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (500)..(500): a, c, t, g, unknown or other
  misc_feature (500)..(500): n is a, c, g, or t
  modified_base (514)..(514): a, c, t, g, unknown or other
  misc_feature (514)..(514): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccaggcccgggaggtccctgagactctcctgtgaagcctntggattcagtctcagtacgtatggttgcgcgtgggtcccnccaggctccgaggcaaagggctgcaggtgggtgcatctatactcatanggaaaggaaanacaataaatctagcagactcgtagaggcatcacatcacaganacaatcccaagaacactacgttacnctanactaaatcgaacaccctagagtacttggacgaccaacggtcttgtcttattagtgttggcgaggaagggnaatcggattcaacnggaacc

SEQ ID NO: 322403 - DNA, 599 bp, Homo sapiens
  misc_feature: GZ8MTXP01B122Y.51.6.A06.1.454.CMB.2.raw
  modified_base (338)..(338): a, c, t, g, unknown or other
  misc_feature (338)..(338): n is a, c, g, or t
  modified_base (580)..(580): a, c, t, g, unknown or other
  misc_feature (580)..(580): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccaggcctggggacggtccctgagactctcctgtgaacgcctctggattcagcttcagtacgtatggtttgcgctggggtcccgccaggctcgaggcaaggggactggcaggtgggngcatctatatcatataggaaaaggaagcaaaattaaaactactaaccgacaaggtaccgtacccggtaggaacggggaccctaattaccaaccctatacctaccgaagaccgaaacaactacccaaagaaaccaacgtacttttaatctacgaccaaagtcgaaacctaaccctgtaacgtaccttacggaacggaactacggttctcgttacttattagttgttgacggaaggaggggaanaactcgactcgaacgaacg

SEQ ID NO: 322404 - DNA, 495 bp, Homo sapiens
  misc_feature: GZ8MTXP01DVP9A.51.6.A06.1.454.CMB.2.raw
  modified_base (328)..(328): a, c, t, g, unknown or other
  misc_feature (328)..(328): n is a, c, g, or t
  modified_base (392)..(392): a, c, t, g, unknown or other
  misc_feature (392)..(392): n is a, c, g, or t
  modified_base (429)..(429): a, c, t, g, unknown or other
  misc_feature (429)..(429): n is a, c, g, or t
  modified_base (463)..(463): a, c, t, g, unknown or other
  misc_feature (463)..(463): n is a, c, g, or t
  modified_base (479)..(480): a, c, t, g, unknown or other
  misc_feature (479)..(480): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaacccactattcttaattggtaccagcagaagccaggccaggcccctgtgttgttgatatataaagacactgagaggccttcagggatccctgagcgattcnctcggctcactcagggaacaatggtcacattgaccatcagtgagtccaggcagaagacgaggcngactatttcagtcaatcttcagacatcagtgtacttntgtcttcgaatggaccaaggtcacgtctggttcngcccaaggccaacccnncgttcaacttctccg

SEQ ID NO: 322405 - DNA, 523 bp, Homo sapiens
  misc_feature: GZ8MTXP01EO82X.51.6.A06.1.454.CMB.2.raw
  modified_base (509)..(509): a, c, t, g, unknown or other
  misc_feature (509)..(509): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggaggtccctgagactctctgtgagcctctggattcagcttcagtacgtatggtttgcgcgtgggtccgcaggctccgaggcaagggactgcaggtgggtgcatctatatcatatgaaaaggaagcaaataaatactacgcagactccgtagaacggcgatcaccatctaccagacgacaactacccaaagaaccaactactttatcctagacaaatcgaaacacccgtgaacgacttgaggaactacggctagttctattattgttgcgaaggagggaanatgatcaacgaacg

SEQ ID NO: 322406 - DNA, 592 bp, Homo sapiens
  misc_feature: GZ8MTXP01CH9FM.51.6.A06.1.454.CMB.2.raw
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagaggccttcagggactcctgagcgattctctcggctcacctcagggaacaatggcacattgaccatcagtggagtccaggcagaagacgaggctgacttntttctgtacaatcttacanacgatcgagttggttaactttagtcggttctttaccgggtaaacgtcgggggaacccttaaagggtcccttaacccggttacccgttaaggggttcccgaacggacccccgaaaacggggaccccctaaacccccgtacgttcccggttacctaacccgttcccgttttaaccccgg

SEQ ID NO: 322407 - DNA, 544 bp, Homo sapiens
  misc_feature: GZ8MTXP01AY1TL.51.6.A06.1.454.CMB.2.raw
  modified_base (355)..(355): a, c, t, g, unknown or other
  misc_feature (355)..(355): n is a, c, g, or t
  modified_base (433)..(433): a, c, t, g, unknown or other
  misc_feature (433)..(433): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggaggtccctgagactctcctgtgaagcctctggattcagcttcagtacgtatggtttgcgctgggtccgccaggctccgaggcaaggggctgcaggtgggtgcagtctatatcatatgaaaagaancaaataaatactacgcagactccgtagaacggcatcacatctacagacgacaactacccaaagaaccactaactttanctagaaccaaatcgaaaccaccctgaacgtacttacggaggaacacggttcttagttacttaagtttagttggttcgacggtaaggagggaagtagtcgatccgaagaacg

SEQ ID NO: 322408 - DNA, 585 bp, Homo sapiens
  misc_feature: GZ8MTXP01D9L7L.51.6.A06.1.454.CMB.2.raw
  modified_base (373)..(373): a, c, t, g, unknown or other
  misc_feature (373)..(373): n is a, c, g, or t
  modified_base (464)..(464): a, c, t, g, unknown or other
  misc_feature (464)..(464): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtgggggaggcgtggtccagccgtggggaggtccctgagactctcctgtgaagcctctggattcagcttcagttacgtagttggtttgccgcgtgggtcccgccgaggcctccgaggcaagggggactggcgaggtggtgcatctaatatcagtataggaaaaggaancaaaataaatactacgcacgactccggtagaacgggcctattcaccatactaccagacgacaaactacccaaagaaccacgtaacttttanactagactaaactcgaaaccgaccttgaactacgttaggaacggaacacggttctacgttacgttaatttagttggttcggacggtaagggaaggggaatacgtacggactcgaaccgaag

SEQ ID NO: 322409 - DNA, 576 bp, Homo sapiens
  misc_feature: GZ8MTXP01EAT3H.51.6.A06.1.454.CMB.2.raw
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
  modified_base (343)..(343): a, c, t, g, unknown or other
  misc_feature (343)..(343): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttccgtcgtagctcttttaagaggtgtccagtgtcaggtgcagctggtgcagtcgtgggggaggcgtggtccagccgtgggacgtccctgagactctcctgtgagcctntggattcagtcttacgagttacgtnttggtttcgcgtcttgggcccgcgaggcctccgaggcaaggggctggcgaggtggtggngtatactactatatagtagtagaaagaagaataaataaataactacgacgacgacgtacgtacgacggacgtactacactactactacacgacgaacaacaaccaaacaactaactaacttatactactaactaacaacgaaccaacctacgtacgtacgtacgacggaacgacgcgtcgttagttattagttgttgacggaaggaggaagtagtacgactaacgaacgaacg

SEQ ID NO: 322410 - DNA, 576 bp, Homo sapiens
  misc_feature: GZ8MTXP01DHYP3.51.6.A06.1.454.CMB.2.raw
  modified_base (435)..(435): a, c, t, g, unknown or other
  misc_feature (435)..(435): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgccaacccactattcttattggtaaccagcagaagccaggccacggccctgtgttgtgatatataaagacactgagaggtccttcgagggactcccgtgagcgtattctctcggcctccacctcgagggaaccaagtcggtacaactattagaccatcgaagtgagtccaggacagaagacgaggctgacttattctagtactaagttcttnaaagtacattacgtaggttggttaacttagtgttccgttacggtaacgtcgggaaaccgttagggttccaccggttcctaggttaccgcgaccccgaaacggtaccccaaccccgtactcgttacctccgttccttccccg

SEQ ID NO: 322411 - DNA, 775 bp, Homo sapiens
  misc_feature: GZ8MTXP01BWDNW.51.6.A06.1.454.CMB.2.raw
  modified_base (156)..(156): a, c, t, g, unknown or other
  misc_feature (156)..(156): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttccncgttgtctcttttaagaggtgtccagtgtcaggtgcagctggtgcagtcgtgggggagggcgtggtccagccgtgggaggtccctgagactctcctgtgagcctctggattcagcttcagtacgtatggtttgcgctggggtcccgccgaggctccgagggacgaacgggggacttggacgagggttgggggttcggctaattccgtaactatcaagtatagggaaaaaagggaaacgctaaaattaaaacgtactacccggacctaaggacccgttccgggtacggaaacggggcccgtaacttccaaccctacttaccgtacccgtaagaaacggaaccaaaaccttaccccgaaaacgtaaaccctaacccgttaaacctttttaacgttaaccccttaggaaacccctaaaaagttaccggaaaacccctaacccccgttaggaaaccgggtaacccgtttagggaacggggaaacccgtaacccgggggttaatttcccgggtttaaacttttaaagttttaacgggtttaggttcccggggttaacgggtaaacggggtaaggggggaacctttaaaggggcccttaaaggtaaccgttaaaccgaacccggg

SEQ ID NO: 322412 - DNA, 611 bp, Homo sapiens
  misc_feature: GZ8MTXP01DDM3N.51.6.A06.1.454.CMB.2.raw
  modified_base (256)..(256): a, c, t, g, unknown or other
  misc_feature (256)..(256): n is a, c, g, or t
  modified_base (484)..(484): a, c, t, g, unknown or other
  misc_feature (484)..(484): n is a, c, g, or t
  modified_base (543)..(543): a, c, t, g, unknown or other
  misc_feature (543)..(543): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagactctctgtgaagcctntggattcagcttcagtacgtattgggtttcgcgtcgtcgggtcccgccgaggcctaccgaggcgaaagggggctggcgagggtgggtgctatctatatcaatagtaggaaaacggaataacaaaataaatacgtacgcaaggtacgtaccggtaggaacggggacctaacttccaacctactcctaccgaagaacgaacaactaacccaaagaaaccacttactttanctagaacaaagtacgaacctaacccgtgtaacgtactaggaacggaactaacccggttnttacgttattaagtttgttaggttgacggtaaggaaggggaatacggtcgttaactccgaacgtaacg

SEQ ID NO: 322413 - DNA, 515 bp, Homo sapiens
  misc_feature: GZ8MTXP01C9RDZ.51.6.A06.1.454.CMB.2.raw
  modified_base (408)..(408): a, c, t, g, unknown or other
  misc_feature (408)..(408): n is a, c, g, or t
  modified_base (420)..(420): a, c, t, g, unknown or other
  misc_feature (420)..(420): n is a, c, g, or t
  modified_base (474)..(474): a, c, t, g, unknown or other
  misc_feature (474)..(474): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaaacccatattcttattggtaccagcagaagcagcaggccctgtgttgtgatatataaagacactgagaggccttcgagggatcccgtgagcgattctctcggcctccacctcgaagggaacaaagtcggtacactattcgaccatcagtgatcaggcaagaagacgaggctgtactattcngtacaatcttanagacatcagtgttactatgtcttacggatgggaacaggtcaccgtcgtagttcngacccaacggacccaacccactcgttactaaccttcgtccc

SEQ ID NO: 322414 - DNA, 616 bp, Homo sapiens
  misc_feature: GZ8MTXP01EQ2W7.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgctattcgacccaaaccctacttattcttattcggtaccagcagaagccaggccaggcccctgtgttgtgatatataaagacactgagaggccttcgagggactcccgtgagcgtattctctcggcctccacctcgacgggaacaagtggtacaacattcgaacctagtcgaggtcggagtccgaggcaagaagacggaggtctagacttattctgtctaaagtcttacaagactatcgtagttaggttaactttatcgttacgttaccgggaagtcggggtaacccttaaggggtcccttaacccggttccgttaacgggttccgttacggttacccgaaacgggtcccccaaacccccgttacgtccggttacctaacccgtttcccgtttccccgg

SEQ ID NO: 322415 - DNA, 536 bp, Homo sapiens
  misc_feature: GZ8MTXP01ARLO4.51.6.A06.1.454.CMB.2.raw
  modified_base (521)..(521): a, c, t, g, unknown or other
  misc_feature (521)..(521): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggaggtccctgagactctcctgtgaagcctctggattcagcttcagtacgtatgggtttgcgcgtggggtcccgccgaggcctccgaggcaagggggactgcgaggtgggtgcagtctatatcatatggaaaaggaagcaaataaatactacgcaagactcgtagagggccagtcacatctacagacgacaatacccaaagaccacgtactttaatctagaccaaatcgaaaccacccttgaacgtacttaggagtaacacggttctgttctaattattgttgcgtaaggaggngatgatcaacgaacg

SEQ ID NO: 322416 - DNA, 784 bp, Homo sapiens
  misc_feature: GZ8MTXP01BWB70.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccagccgtgggagtccctgagactctctgtgaagcctctggattcagcttcagttacgtattggtttgcgtctcggggtcccgccgaggcctccgagggacgaaagggggtactggcgagggtggggtcggactattacgttaatatacgaagttaagtacggaaaaaagggaaacgaactaaaagttaaaacttaccgtaaaccgacgtaaacgggtaaccgttacccgggttagggaaaccgggggtaccctaaacgtttacccaaaccccgttaattaccccgttaacccgaaaggaaaccgtaaaaccaaaaccgttaaaccccccgaaaaaagtaaaacccctaaaccgtttaaacctttttaaacgtacccttaacggaaaccctaaaaaacttaccggaaaacccctaaaccccgttaggtaaaccgtaaccgtttagggaaacgggaaaccctaaccggggttcctttaggttaaacctttaaagtttacgttacgggttggaccgggtaagggaacggggtaactaagtacggaactaacccgaaagaacccggg

SEQ ID NO: 322417 - DNA, 586 bp, Homo sapiens
  misc_feature: GZ8MTXP01DJYXJ.51.6.A06.1.454.CMB.2.raw
  modified_base (402)..(402): a, c, t, g, unknown or other
  misc_feature (402)..(402): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggcttcgagggatccctgagcgtattctctcggctcacctcgaggaacaatggtcacattgaccatcagtgagtccaggcagaagacgaggctgacttattcngtacaatcttacagtacatcgagttggttaactttagtcgttcgttacgggaacgtcggggaaccttaaggggttccaacccggttaccgttaacgggttacccgaacggttacccccgaaacgggtacccccaaacccccctaacgttcggttaccctaacccgtttcccttttaacccccgg

SEQ ID NO: 322418 - DNA, 528 bp, Homo sapiens
  misc_feature: GZ8MTXP01D3X9N.51.6.A06.1.454.CMB.2.raw
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
  modified_base (476)..(476): a, c, t, g, unknown or other
  misc_feature (476)..(476): n is a, c, g, or t
  modified_base (508)..(508): a, c, t, g, unknown or other
  misc_feature (508)..(508): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagctggtgcagtcgtgggggaggcgtggtccagccgtggggacggtccctgacgtactctcctggtgaacgcctctggattcagcttcagtacgtatggttncgctgggtccncagctcgaggcaagggctgcaggtggtgcatctatntcatatgaaaagancaaataaanctacgcagactcgtgaacgcatcacatctcaagacacaactaccaaagaacactactttanccgtaanaacaanacaaccacngtacgtactacgacgaacgacgttcttnttacttattgttcggttgacgaaggagggaanacgtacgactcgaacgaacg

SEQ ID NO: 322419 - DNA, 626 bp, Homo sapiens
  misc_feature: GZ8MTXP01BHY99.51.6.A06.1.454.CMB.2.raw
  modified_base (580)..(580): a, c, t, g, unknown or other
  misc_feature (580)..(580): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggagcgtggtccagccgtgggagtccctgagctctctgtgagcctctggattcagcttcagtacgtagttggtttgcgtcgtcgggtcccgccgaggtcctccgaggacgaaggggactggcgaggtgggtgcatcgtatatcatataggaaaaggagcaaataaactacgtacgactaagactaccggtaggaacgggaccgtaattccaacctatacccgtaccgaagacgaaacaacgtaccccaaaagtaacccaacgttaacttttaacgtaccttacgaacctaaagtacgaaacctacccgtagtaaccgtacgttaggaacggtaaccacgggttcttacgttacttaagtttaagtttcggnggttacggaagggtaggggaatacgttcggaactcgaacgtaacgg

SEQ ID NO: 322420 - DNA, 708 bp, Homo sapiens
  misc_feature: GZ8MTXP01A0AMT.51.6.A06.1.454.CMB.2.raw
  modified_base (216)..(216): a, c, t, g, unknown or other
  misc_feature (216)..(216): n is a, c, g, or t
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagccaccctcggtgtccgtgtccccaggacagacggccaggatcacctgctctgganatgctattcgacccaaaccctacttattcttattcggtaccagcagaagccaggccacggccctgtgttgtagatataataaagacactgagagccttagaggtactcccgtgagcgtattctcgtccggcctccgtacctacgaacggggaaacctaaagtcggtactaaactagttacgaacctagttacgaagggttacgggacgtacccgaagggaccgaaagggaaacggaacccgggtagggtaccgttacggtaaactttaaacgtttccgtaacggttacctaaacgtttccttaaccggaaagttaaaccctaagttaccgtaaggttacggtttaaactttagtcggttaccgttacggtaaccgtaagggtaacccgttacgggttaccacccggttcgtaacggttacccgaccggttaaccccgaaacccggcccctaaaaccccgtcggtacttaaccctccgtttccgttaaccccg

SEQ ID NO: 322421 - DNA, 548 bp, Homo sapiens
  misc_feature: GZ8MTXP01DPLRC.51.6.A06.1.454.CMB.2.raw
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
  modified_base (480)..(480): a, c, t, g, unknown or other
  misc_feature (480)..(480): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggagtccctgagactctcctgtgaagcctctggattcagcttcagtacgtatggtttgcgctgggtcccgcgaggctcccgaggcgaagggactggcaggtgggtgcatctatatnatatgaaaaggaancaaataaatactacgcagactcgtagaacggcatcacatctcagacgacaactacccaaagaccactaactttatacctacgaacaaacgtcgaaccaaccctgacgtactacggacggaacncggttctacgttattattagttcggttcgacggtaaggaagggaagaacgtcggactcgaacgtaacg

SEQ ID NO: 322422 - DNA, 577 bp, Homo sapiens
  misc_feature: GZ8MTXP01A5ZQ5.51.6.A06.1.454.CMB.2.raw
  modified_base (300)..(300): a, c, t, g, unknown or other
  misc_feature (300)..(300): n is a, c, g, or t
  modified_base (474)..(474): a, c, t, g, unknown or other
  misc_feature (474)..(474): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggagtccctgagactctcctgtgaagcctctggattcagcttcagtacgtatggtttgcgtcgtggggtcccnccaggctccgaggcaagggctgcgaggtgggtgcatctaatatcatataggaaaaggaagcaaaattaaagtacctaaccggacaagtaccgtaccggtagaacggggccgtaattccaaccattcctacccgaagaacgaaccaaactacccaaagaaccaacgtaactttanctagacaaatcgaaacaccctgaacgtactgacggtaacaacggttctagttcttaattagttgttcgacggaaggagggaagtactcggatccgaacgaacg

SEQ ID NO: 322423 - DNA, 572 bp, Homo sapiens
  misc_feature: GZ8MTXP01B0J31.51.6.A06.1.454.CMB.2.raw
  modified_base (437)..(437): a, c, t, g, unknown or other
  misc_feature (437)..(437): n is a, c, g, or t
tcagcgatcgtatacacgaccggtgctcgatttagatctactgacagggggtgggtccaggaggcagaactctgggtgtctcaccatggtcctggatccctctacttctccccctcctcactctctgcacaggctctgaggcctcctatgtgctgacacagccaccctcggtgtccgtgtccccaggacagacggccaggatcacctgctctggagatgctattcgacccaaaccctattattcttattggtaccagcagaagccaggccaggccctgtgttgtgatatataaagacactgagagccttagagggactcccgtgagcgtattctctcggctccactcgagggaaccaagtggtacacgtattcgacctatcgagtggagtccaggcaagaagacgaggctagacttattcagtacaagttcttaganacatcagttgtacttatgttacgttacggaacgtaacgggaaccttaagggtccttaccgttacgtacgggttcgaacggaccccgaaacgggccccaaacccgtagtccgttacctccgttaaccgtttccccg

SEQ ID NO: 322424 - DNA, 645 bp, Homo sapiens
  misc_feature: GZ8MTXP01AINU5.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccatattcttattggtaccagcagaagccaggccaggcccctgtgttgtgatatataaagaccactgagacggcctttacgagggtaactcccgtagagcgtaactttctctcgggccttccgaacccttcgacggggaccaaagtcgggtacactattacggaccagtaccgaggttacgggggaagttaccccgaagggccgaaaggaaacggacggaaggggtaccttagggtaaccctttaagttttccgttcggttaacctaaactttccgtttacaaacggtaaccctagttaccgttaggttaggtttaaccctttaagttcggttaccgtttaccgggttaaacgttcggggaaacccgttaaaccgggg

SEQ ID NO: 322425 - DNA, 627 bp, Homo sapiens
  misc_feature: GZ8MTXP01BE5YJ.51.6.A06.1.454.CMB.2.raw
  modified_base (470)..(470): a, c, t, g, unknown or other
  misc_feature (470)..(470): n is a, c, g, or t
  modified_base (605)..(605): a, c, t, g, unknown or other
  misc_feature (605)..(605): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtgggacggtccctgagctctctgtgacgcctctggattcagcttcagttacgtatggtttgcgtcgtgggtcccgcgaggctccgaggacgaagggactggcgagggtgggtggctatctatatcatataggaaaaggaagctaaataaactacgtacgacgacgacgtacccggtaggaacgggtacccgtattaccaacctactaccctacccaaggaaccgaaccaaactaccccgaaanaaaccctaacgtaacttttaactaccttacgaacctaaaataccgaaacctaacccgtagaacgtacttacggacggtaaccgacggttcgtacgttcttagttacgttggttggttacggaagggaggggtaanacgtcgactaaccgaacgaacg

SEQ ID NO: 322426 - DNA, 583 bp, Homo sapiens
  misc_feature: GZ8MTXP01EFB26.51.6.A06.1.454.CMB.2.raw
  modified_base (542)..(542): a, c, t, g, unknown or other
  misc_feature (542)..(542): n is a, c, g, or t
  modified_base (563)..(563): a, c, t, g, unknown or other
  misc_feature (563)..(563): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggaggtccctgagactctcctgtgaagcctctggattcagcttcagttacgtatgggtttgcgcgtggggtcccgccaggctcccaggcaaggggactggcaggtgggtggcatctatatcatataggaaaaggaagcaaattaaaatacctacgacaaggactacccggtagaacgggccgaattccaccatcctaccaagaacgacaaactaccccaaagaaccactaactttatcctagacaaagtgaaaccaacccgtgaagtaccgttaggaaggaacgtacgggactcggttacgtaattaagtttggnggaccggaaggaagggggaanagtcggactcgaacgtaacg

SEQ ID NO: 322427 - DNA, 639 bp, Homo sapiens
  misc_feature: GZ8MTXP01BF65T.51.6.A06.1.454.CMB.2.raw
  modified_base (382)..(382): a, c, t, g, unknown or other
  misc_feature (382)..(382): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggtttttcctcgttgctcttttaagaggtgtccagtgtcaggtgcagctggtgcagtcgtgggggaggcgtggtccagccgtgggaggtccctgagactctctgtgaagcctctggattcagcttcagttacgtagttgggtttgcgtcgtcggggtcccgccgaggtcctcccgaggacgaaagggggctggcgaggtgggtgcatctaatatcaatagtaggaaaaagggaanaacaaaattaaaactacgtaacgacaacggaccgtaccggtaggaaacggggcctaattccaacccattacctaccaagaacgaaaccaaactaccccaaaagaaaccctaacttaacttttaacgtaccttacggaaacctaaaataccggaaacctaccccgttagaacgtaccgttaggaacggtaaccacgggttcttagttacttaagtttattggttgacggaaggaggggaatacgtagatcaacgaacg

SEQ ID NO: 322428 - DNA, 594 bp, Homo sapiens
  misc_feature: GZ8MTXP01DR54Q.51.6.A06.1.454.CMB.2.raw
  modified_base (215)..(215): a, c, t, g, unknown or other
  misc_feature (215)..(215): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtcccgtgtccccaggacagacggccaggatcacctgctctgganatgcattgccaaccatattctatggtaccagcagagccaggccaggccctgtgttgttgatatataaagcactgagaggccttcgagggtacttcccgtgagtcgattctctcggccttaccacctcgagggaaccaagtggttacactattacgaaccctattcgaagttggagtccaggcaaggaagacgaggctagacttattctagtctaaagttcttcaagactatcgtagttggttaaactttgtgttacttacgggaaacgttaacgggaaccttaaagggtccttaaccggttaccgtaacgggttaccacggaccccgaacgggaccccaaaccccgtactccggttacctaaccgttcccgtttccccg

SEQ ID NO: 322429 - DNA, 522 bp, Homo sapiens
  misc_feature: GZ8MTXP01DCS36.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctggggaggtccctgagactctcctgtgaagcctctggattcagcttcagtacgtatgggtttgcgctggggtccgccaggctccaggcaaggggactgcaggtgggtggcatctatatcatatgaaaaggaagcaaataaatactacgcagactccgtgaagggccgattcaccatctccagacgacaatcccaaagaaccactaactttatctagacaaatcgaaacaccctgacgacttgaggaacacggctgttctattattgttgcgaaggagggaagatcgatcgaacgaacg

SEQ ID NO: 322430 - DNA, 732 bp, Homo sapiens
  misc_feature: GZ8MTXP01DMROR.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaacccacttattcttattggtaccagcagaagcaggccaggccctgtgttgtgatatataaagacactgagacggcttcgagggtactcccgtgacgcgtacttctcgtcggcctaccacctcgaacggggaaaccaaagtcgggtacaactaactttacgacctaatacgaggtacggacgtaccgaagggacaaaggaaacggaacggacgggtactacggtaaacctttagtttccgtagtaacctaaacgttctttaaccgaagaaccttaagttaccgtaggttacggtttaaacctttagttacgggtttaccgttaaccgggtaaaccggttaacgggggaaacccttaaacgggggttacccgttaaaccccggtttaccggtaaccgggttacccgttaaaccgggaaccccccgtaaaccggggaacccccctaaaaccccccggtaccttaccgggttacccttaaccccggttaacccgttttccccccgg

SEQ ID NO: 322431 - DNA, 605 bp, Homo sapiens
  misc_feature: GZ8MTXP01BQNAC.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgaccaaaccctacttattcttattcggtacccagcagaagccaggccaggcccctgtgttgtgatatataaagacactagagaggccttcgaggactccctgagcgtattctctcggcctccacgtcgagggaaccaagtggacactattcgacctatcagtgagtccaggcaagaagacgaggctgaacttagtttctagtacaagttctttacgaacgtaacctagtccgtaaggttaggtttaaccttaagttcgtttacgttaccggtaaacgtaacgggaaaccgttaagggtacccttaccggttaccgttaggttaccgacgaccccgaaacggtccccaaacccgtacgtcgttacctaaccttccgttccccg

SEQ ID NO: 322432 - DNA, 572 bp, Homo sapiens
  misc_feature: GZ8MTXP01BZVPR.51.6.A06.1.454.CMB.2.raw
  modified_base (368)..(368): a, c, t, g, unknown or other
  misc_feature (368)..(368): n is a, c, g, or t
  modified_base (450)..(450): a, c, t, g, unknown or other
  misc_feature (450)..(450): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccagccgtggggacgtccctgagactctcctgtgaagcctctggattcagcttcagttacgtatggtttgcgtcgtgggtcccgcgaggctccgagggcgaaagggggctggcagggtgggtgcatctatatcatataggaaaagaancaaataaactactacgcaggactccgtagaacgggcctatcacatccacagacgacaactacccaaagaacacgtactttanctacgacaaatcgaaaccacccgtagaacgtacttaggaggaacctacggttcttagttacttaagtttagttgggttgacggtaagggagggggtaataacgtcggaattccgaagtaacg

SEQ ID NO: 322433 - DNA, 563 bp, Homo sapiens
  misc_feature: GZ8MTXP01EKN8B.51.6.A06.1.454.CMB.2.raw
  modified_base (322)..(322): a, c, t, g, unknown or other
  misc_feature (322)..(322): n is a, c, g, or t
  modified_base (418)..(418): a, c, t, g, unknown or other
  misc_feature (418)..(418): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattcgacccaaaccctattattcttattcggtaccagcagaagccaggccaggccctgtgttgtgatataataaagacactgagaggccttgaggactccgngagcgtattctctcggcctaccactcgagggaaacaagtcggtacactattcgacctatcgagtggagtccgaggacaagtagacgagctagattnttctatactaagtcttcaatacatcgtagttgttaacttagtcgttacgttacggaacgttaaggggaaccttaaagggtccttacgtcgtaagcgcgacccgaacggacccaaccgtactcgttacctaaccgttcgttccccg

SEQ ID NO: 322434 - DNA, 586 bp, Homo sapiens
  misc_feature: GZ8MTXP01B4DAQ.51.6.A06.1.454.CMB.2.raw
  modified_base (299)..(299): a, c, t, g, unknown or other
  misc_feature (299)..(299): n is a, c, g, or t
  modified_base (448)..(448): a, c, t, g, unknown or other
  misc_feature (448)..(448): n is a, c, g, or t
  modified_base (538)..(538): a, c, t, g, unknown or other
  misc_feature (538)..(538): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggaggtccctgagactctcctgtgaagcctctggattcagcttcagtacgtatgggtttgcgcgtgggtcccncgaggctccgaggcgaagggctgcaggtggtgcatctatatcatataggaaagaagctaaataaatactacgcaagacgtacgtagaacggcccgtattacaccatacctaccgaagacgacaactacccaaagtaaccactactttanctacgactaaacgtcgaacctacccgtgaaacgtaccttggaacggtaaccgtacgggttacttcggttaccttaagtttagtttacggngggacgggaagggtaggggaatacgtcggactaaccgaacgtaaccgg

SEQ ID NO: 322435 - DNA, 611 bp, Homo sapiens
  misc_feature: GZ8MTXP01AMFEW.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggacgtccctgagactctcctgtgaagcctctggattcagcttcagttacgtattgggtttgcgtcgtggggtcccgccgaggcctccgagggaccgaagggggacctggacgtagggttggggtcggctatctaatactcaatataggaaaaacggaagaacaaataaaactactacgcagactaccggtagaacgggtcctattccaacctatcctaccgaagacgaactaaactacccaaacgaaccaacttactttactctacgaacctaaatacgaaacctacccgtagaacgtacgttaggaacggaacacgggttcttacgttcttaagttagttggttcggacggaaggagggaagtataccggatcgaacgaacg

SEQ ID NO: 322436 - DNA, 527 bp, Homo sapiens
  misc_feature: GZ8MTXP01EKGNF.51.6.A06.1.454.CMB.2.raw
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccatattctatggtacagcagaancagcaggccctgtgtgttgatanataaagcactgagagccttgaggactcctgagcatctctcggctcacctcgacggaacaaagtggtcaacattgaccaatcagtgagcaggcaagaagacgtaggctgactatttnagtanagtctanagtacatacgtagtagttacgttagtgtacgtacgtacgtaacggtaacgttaacgtacgttaccgtacgtacgttacgacgaccgaaccgacccgaacccacctacgttactaaccgttcgtccg

SEQ ID NO: 322437 - DNA, 495 bp, Homo sapiens
  misc_feature: GZ8MTXP01AOB4Q.51.6.A06.1.454.CMB.2.raw
  modified_base (397)..(397): a, c, t, g, unknown or other
  misc_feature (397)..(397): n is a, c, g, or t
  modified_base (460)..(460): a, c, t, g, unknown or other
  misc_feature (460)..(460): n is a, c, g, or t
  modified_base (478)..(478): a, c, t, g, unknown or other
  misc_feature (478)..(478): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccatattcttattggtaccagcagaagccaggccaggcccctgtgttgttgatatataaagacactgagaggccttcagggatccctgagcgattctctcggctcacctcagggaacaatggtcacattgaccatcagtggatccaggcagaagacgaggctgactattcngtcaagtcttcagacatcagtgtacttatgtcttcggaatgggaccaggtcacgtctagttcncgcccaaggcccaacccntcgctaacttcgtcccg

SEQ ID NO: 322438 - DNA, 590 bp, Homo sapiens
  misc_feature: GZ8MTXP01CX1Z3.51.6.A06.1.454.CMB.2.raw
  modified_base (237)..(237): a, c, t, g, unknown or other
  misc_feature (237)..(237): n is a, c, g, or t
  modified_base (299)..(299): a, c, t, g, unknown or other
  misc_feature (299)..(299): n is a, c, g, or t
  modified_base (359)..(359): a, c, t, g, unknown or other
  misc_feature (359)..(359): n is a, c, g, or t
  modified_base (453)..(453): a, c, t, g, unknown or other
  misc_feature (453)..(453): n is a, c, g, or t
  modified_base (539)..(539): a, c, t, g, unknown or other
  misc_feature (539)..(539): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggagcgtggtccagccgtgggagtcccngagactctctgtgagcctctggattcagcttcagtacgtatggtttgccgtcgtgggtcccncaggctccgaggcaagggctggcaggtgggtgctatctatatcatagtaggaaaaggaancaaataaatactacgcagacctcgtagaacggccgattccgacctagtctaccgagtacgaacaactacccaaagtaaccacgtaactttaacncctagacaaatcgaaacctacccgtgtaacgtaacttcgggaacgtaacgacgggttacttcggttaccttaaagttgtttacggnggttaccggaaggggtaacgggaagtacgtacgttaactccgaacgtaacg

SEQ ID NO: 322439 - DNA, 655 bp, Homo sapiens
  misc_feature: GZ8MTXP01ADC7X.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgctattacgaccctaaaccctacttattttccgtttaatttcggtaacccaagtcgaaggaaacggcccaaggcccaacggcccccttggtgtttgttgatataataaagacactgagacggtcttcgaggactcccgtgagtcgattctcgtcggcctcacgtcgagggaacagtggcatattcgacatcgagtgagtcgagacaggaagacgagctagactatttcagttcaaacgttcttacagtaacctagtacgtaggttcggtttaacttagttcggttaccgtttaacgggaacgttcgggggtaaccttaaggggtccccttaaacccggttccggtaacgggttacccgaaaccggacccccgtaaaccgggcccccctaaacccgtaccgggttacgttaccccgtaacctttccgtttccccccgg

SEQ ID NO: 322440 - DNA, 768 bp, Homo sapiens
  misc_feature: GZ8MTXP01AWPMN.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattcgacccaaccactattcttattggtaccagcagaagccaggccaggcccctgtgttgtgatatataaagcactgagaggccttgagggactccctgacgcgattctctcggctccacctcgaggggaaacaagtcgggtacacgtactttagaccctaatccgaggtcgggtaacgttacccgaaaggggccgaaaggaaacggaaccggaaggggtcccttagggtaactttaacttttccgtagtttacctaaagttccttttaccgaaagtaaccctaattacccgtaaggtttacggggtttaacttttaaacgttcgggtttaacccgttttaaccgggggtaaaccgtttaacggggggtaaaacccccgttaaaggggggtttaccccttaaaccccggggtttaccccgttaacggggggttaaccccttaaccggggttacccccccgggtaaaaaccgggggtaccccccaaaacccccccgtaacccggtttaccgggttaccccgtaacccgttttcccgttttaaccccccggg

SEQ ID NO: 322441 - DNA, 564 bp, Homo sapiens
  misc_feature: GZ8MTXP01B30EB.51.6.A06.1.454.CMB.2.raw
  modified_base (369)..(369): a, c, t, g, unknown or other
  misc_feature (369)..(369): n is a, c, g, or t
  modified_base (407)..(407): a, c, t, g, unknown or other
  misc_feature (407)..(407): n is a, c, g, or t
  modified_base (433)..(433): a, c, t, g, unknown or other
  misc_feature (433)..(433): n is a, c, g, or t
  modified_base (480)..(480): a, c, t, g, unknown or other
  misc_feature (480)..(480): n is a, c, g, or t
  modified_base (516)..(516): a, c, t, g, unknown or other
  misc_feature (516)..(516): n is a, c, g, or t
  modified_base (541)..(541): a, c, t, g, unknown or other
  misc_feature (541)..(541): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgtctcttttaagtaggtgtccagtgtcaggtgcagctggtgcagtcgtgggggaggcgtggtccgagccgtgggaggtccctgagactctcctgtgagcctctggattcagcttcagtacgtattggttgcgctgggtcccgcaggctccgaggacgaagggactcgcgaggtggggtgcatctaagtattcagtagtagaaaagggaancaaataaatactacgcagacgtccgtgaggcgatcacntactcagagacactacccaagaaacnctaactttatcagactaaatcgaacctacctggaagtaccgttaggngggaaaccctcgggttcttacggttcttaaagtttnttagggttggacggtaagggagggngtaacgttgacttaagccgtaag

SEQ ID NO: 322442 - DNA, 562 bp, Homo sapiens
  misc_feature: GZ8MTXP01DTRNV.51.6.A06.1.454.CMB.2.raw
  modified_base (285)..(285): a, c, t, g, unknown or other
  misc_feature (285)..(285): n is a, c, g, or t
  modified_base (356)..(356): a, c, t, g, unknown or other
  misc_feature (356)..(356): n is a, c, g, or t
  modified_base (418)..(418): a, c, t, g, unknown or other
  misc_feature (418)..(418): n is a, c, g, or t
  modified_base (431)..(431): a, c, t, g, unknown or other
  misc_feature (431)..(431): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggttncgctgggtccgccaggctccgaggcaaaggggctgcaggtgggtgcatctatatcatatgaaaagggaaanaacaaataaatactacgacacgactcgagaacggcatcacatcacagacaacaacaccaaanaacactaacttanactagaactaaagtacgaaaccaccgtagaacgtaacgtacggaacggaacgtacggttcttacgttacttaagtttagttggttcgacggtaagggagggaagtacgtacgttactaaccgaacgtaacg

SEQ ID NO: 322443 - DNA, 633 bp, Homo sapiens
  misc_feature: GZ8MTXP01CPAGU.51.6.A06.1.454.CMB.2.raw
  modified_base (313)..(313): a, c, t, g, unknown or other
  misc_feature (313)..(313): n is a, c, g, or t
  modified_base (379)..(379): a, c, t, g, unknown or other
  misc_feature (379)..(379): n is a, c, g, or t
  modified_base (476)..(476): a, c, t, g, unknown or other
  misc_feature (476)..(476): n is a, c, g, or t
  modified_base (495)..(495): a, c, t, g, unknown or other
  misc_feature (495)..(495): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgaggtcggtgggggagcgtggtccaggccgtggggacgtccctgacgactctcctgtgaagcctcgtggattcagcttcgagttacgtattggttgcgtcgtcggggtcccnccgaggcctccgaggacgaagggctgcgaggtgggtgctatctatatacatagtaggaaaaggaanaacaaaataaatacctaacgactaacgacctaccggtaggaacgggacctaacttccaacctactacctaccaaggaacaaccaaacaaccccaaanaaaccaacgtaactttaancctaaacgaactaaacgtacgaaacctaccgtagtaacgtacgtacggaacgaacgtacggttacgttagttacgttaagttagttaggacggacgggaagggagggtaacgtacgtacgttactaaccgaacgaacg

SEQ ID NO: 322444 - DNA, 506 bp, Homo sapiens
  misc_feature: GZ8MTXP01CU5BE.51.6.A06.1.454.CMB.2.raw
  modified_base (215)..(215): a, c, t, g, unknown or other
  misc_feature (215)..(215): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattgccaacccatattcttattggtaccagcagaagccaggccaggcccctgtgttgttgatatataaagacactgagaggccttcgagggatccctgagcgattctctcggctccactcagggaacaatggtcacattgaccatcagtgatccaggcagaagacgaggctgacttattctgtacaagtcttcagacatcagttggtacttatgttctcggaactggacaggtcacgtcgtagttcagcccaaggtcccaacccgactcgacctaacttcgttcccg

SEQ ID NO: 322445 - DNA, 704 bp, Homo sapiens
  misc_feature: GZ8MTXP01BQC4C.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgcattcgccaaaccctatattcttattcggtaccagcagaagccaggccaggcccctgtgttgtgatataataaagacactgagaggccttcgagggactccctgagcgtattctctcggcctaccacctcgacgggaaacctaagtcgggtacaacgtatttacggaaccctagtaccgtaaggttacgggaacgttaccgaacggggaccgaaagggaaaacggtaacccggggaaggggtaccttaggtaaaccttaagttttccgttagttaccgttaaaacgtttcttttaacgaaacggtaacccttaagttcccgtaaggtttagggtttaacctttagtttacggtttaccgtttaaccgggtaaacggttaacggggaaaccgttaacgggtacccttaccggttacccgtacgttaccgaccgacccgaaacggcccctaaccccgtactaccgttctaaccgttcgttaaccccg

SEQ ID NO: 322446 - DNA, 600 bp, Homo sapiens
  misc_feature: GZ8MTXP01CLRD5.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtcgtccccaggacagacgccaggatcacctgctctggagatgcattcgacccaacccactattcttattggtaccagcagaagccaggccaggcccctgttgtgtgatatataaagaccactgagaggcccttacgagggtaactcccgtagacgtcgattcctcgtcggcccttcccacccttacgaaggggaacctaagtcggttaccaactatttacgaaccctaataccgaggttggggacgtcccgaggaccaaagaacgacgagggcctagtacttatttcgtgtaactaaattcttacagtaacctgttaccgttaggttcggttaactttagtcgtttcgttacggggaaccgttcggggaacccgttaaaccgggg

SEQ ID NO: 322447 - DNA, 608 bp, Homo sapiens
  misc_feature: GZ8MTXP01D8W2E.51.6.A06.1.454.CMB.2.raw
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
  modified_base (366)..(366): a, c, t, g, unknown or other
  misc_feature (366)..(366): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggaggcgtggtccagccgtggggacggtccctgagactctcctgtgaacgctctggattcagcttcagttacgtatggtttgcgtcgtgggtccnccgaggcctccgaggcaaggggctgcgaggtgggtgcatctatatnatatagaaaagaacnaaataaatacgtacgcaagacgtccgaggaacgggcctattccaactatacctacagacgaaacaactacccaaagtaaacctacgtaactttaactcctagaacctaaatcgaaacctaacccgtgaaacgtacgttacggaacggaaaccgtcgggttacttcggttactaagtttaagttgggttacggacgggtaaggaaaggggaagtaacgttccggaactccgaaccggtaacgg

SEQ ID NO: 322448 - DNA, 604 bp, Homo sapiens
  misc_feature: GZ8MTXP01DQC5T.51.6.A06.1.454.CMB.2.raw
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagccaccctcggtgtccgtgtccccaggacagacggccaggatcacctgctctggagatgcattcgaccaaacccattattcttattggtaccagcagaagccaggccacggcccctgtgttgttgatataataaagacactgagaggccttgaggactcccgtgagcgattctctcggctcactcaggaacaatcggtcactattcgaccatcgagtggacgtccaggcagaagacgaggctgacttattctagtactaagttcttacaagtacctatcgtaggttaggttaactttagttcgttacgttaccgggtaaacgtcgggtaaacccgttagggttacccgaccggttaccgtacgggttccgaaccggaccccgaaacgggtaaccccctaaaccccgtacgttacggttaccctaaccgttcccgtttcccccgg

SEQ ID NO: 322449 - DNA, 689 bp, Homo sapiens
  misc_feature: GZ8MTXP01ACR00.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattcgccaaaccactattcttattggtaccagcagaagccaggccaggccctgtgttgtgatatataaagacatgagaggcctttcgagggatcccgtgagcgattctcgtcggcctccacctcgagggaaccaagtggtacactatttacgacctagtactaggtggaacgtcccgaaggggcctaaggaaaggaaccggtagggtacccttaggtaaccttaagttttcctagtaacttaacgttcttacgaagtaacctataccgtaggttacggtttaacctttagttgggttaccctttacgggggaaaccgtttaacgggggaaaccccgttaaagggggtttccccaacccggtttacccggttaaacgggggttcccaaacccgggaccccgtaaaaccggggaccccctaaacccccgtaacgttccgggttaccctaacccgttcccggttttaacccccg

SEQ ID NO: 322450 - DNA, 545 bp, Homo sapiens
  misc_feature: GZ8MTXP01B0CY8.51.6.A06.1.454.CMB.2.raw
  modified_base (384)..(384): a, c, t, g, unknown or other
  misc_feature (384)..(384): n is a, c, g, or t
  modified_base (410)..(410): a, c, t, g, unknown or other
  misc_feature (410)..(410): n is a, c, g, or t
  modified_base (424)..(424): a, c, t, g, unknown or other
  misc_feature (424)..(424): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgaccaaaccactattcttattggtaaccagcagaagccaggccagcccctgtgtgttgatatataaagacactgagaggcttcgagggactccctgagcgattctctcggctcactcaggaacaagtgtacacattgaaccatcagtggacgtaccgagganaagaaagacgtaggctagatactttnatactagtctaganactatagtagtagttacttagtagtacgtacgtaacgtaacggtaacgttaacgtacgttaccgtaccgtacgttacgacgaccgaaccgacccaacccactacttactaacgttcgtccg

SEQ ID NO: 322451 - DNA, 553 bp, Homo sapiens
  misc_feature: GZ8MTXP01ECR20.51.6.A06.1.454.CMB.2.raw
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (399)..(399): a, c, t, g, unknown or other
  misc_feature (399)..(399): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttggggttttcctcgttgctctttttaagaggtgtccagtgtcaggtgcagctggtgcagtcgtgggggaggcgtggtccagcctgggaggtccctgagactctcctgtgaagcctctggattcagcttcagttacgtatggtttgcgtcgtgggtcccgccgaggctcccgaggcaaggggctggcaggtgggtgcatctatntnatangaaaagagcaaataaatacacgcagactcgagaggcatcacatcncagacacaactaccaaagaacaactacgtttatcctagacaaactcgaaacctacccgttagaacgtacttggaacggaacaacgggttcctaggttacttaagtttaagttggttgaccggtaaggagggaagtaacgtcgaatcaacgaacg

SEQ ID NO: 322452 - DNA, 550 bp, Homo sapiens
  misc_feature: GZ8MTXP01CQMYS.51.6.A06.1.454.CMB.2.raw
  modified_base (452)..(452): a, c, t, g, unknown or other
  misc_feature (452)..(452): n is a, c, g, or t
  modified_base (534)..(534): a, c, t, g, unknown or other
  misc_feature (534)..(534): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagactctcctgtgaagcctctggattcagcttcagtacgtatgggtttgcgctgggtcccgccaggctccgaggcaagggctgcaggtgggtgcagtctaatatcatatggaaaaggaagcaaaataaatactaacgcaaggactccgtagaacgggccattcaaccatctacccaagacgaacaaactaccccaaagaaccacgtaactttanctagacaaatcgaacaaccctgaacgtacttgaaggtaacaacgggcttaggttcttaattagttggttgacgaaggagggnagtcgatcaacgaacg

SEQ ID NO: 322453 - DNA, 595 bp, Homo sapiens
  misc_feature: GZ8MTXP01DZ2LQ.51.6.A06.1.454.CMB.2.raw
  modified_base (383)..(383): a, c, t, g, unknown or other
  misc_feature (383)..(383): n is a, c, g, or t
  modified_base (473)..(473): a, c, t, g, unknown or other
  misc_feature (473)..(473): n is a, c, g, or t
  modified_base (523)..(523): a, c, t, g, unknown or other
  misc_feature (523)..(523): n is a, c, g, or t
  modified_base (574)..(574): a, c, t, g, unknown or other
  misc_feature (574)..(574): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctggggtttttcctcgttgcttcttttaagaggtgtccagtgtcaggtgcagctggtgcagtcgtgggggaggcgtggtccagccgtgggacggtccctgagactctcctgtcggggaagcctctggattcagcttcagttacgtagttggtttgcgcgtgggtcccgccgaggcctccgaggacgaaagggggtctggcgaggtggggtcggcatctatatcatataggaaaagggaanctaaaataaactaactacgacagactcgtgaaggccgatcacatctaccagacgacaaactaccaaagaaccactaactttataccgtanaactaaactacgaaaccaacccctagaacgtaaccgttaggacggaaacncgggttcttacggttacttaagttagttggttgacgggtaaggaggggaanacgtacggactcgaacgaacg

SEQ ID NO: 322454 - DNA, 518 bp, Homo sapiens
  misc_feature: GZ8MTXP01AW1LL.51.6.A06.1.454.CMB.2.raw
  modified_base (401)..(401): a, c, t, g, unknown or other
  misc_feature (401)..(401): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaacccatattcttattggtaccagcagaagccaggccaggccctgtgttgtgatatataaagacactgagaggccttgagggactcccgtgagcgattctctcgctcactcaggaacaatgcacattcgacctatcagtgagtccgaggcaagaagacgagctgactattcngtacaatcttacagacatcagtggtacttatgtcttcggacgtggaaccttaggtccaccgtcgtaggttcgcgacccaaggcccaacccgactcgttacctaacgttcttaacccg

SEQ ID NO: 322455 - DNA, 499 bp, Homo sapiens
  misc_feature: GZ8MTXP01APPX9.51.6.A06.1.454.CMB.2.raw
  modified_base (443)..(443): a, c, t, g, unknown or other
  misc_feature (443)..(443): n is a, c, g, or t
  modified_base (463)..(463): a, c, t, g, unknown or other
  misc_feature (463)..(463): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacgccaggatcacctgctctggagatgcattgccaacccactattcttattggtaccagcagaagccaggccaggcccctgtgttgttgatatataaagaccactgagaggccttacagggctccctgagcgattctctggctccactcagggacaatggtcactattgaccatcagtggggacgtccgaggcagagacgaggctgactatttcngtcaattcttcagacattcngttgtaacttatgtcttcggatgggaaccgtaacgg

SEQ ID NO: 322456 - DNA, 565 bp, Homo sapiens
  misc_feature: GZ8MTXP01CO2CX.51.6.A06.1.454.CMB.2.raw
  modified_base (249)..(249): a, c, t, g, unknown or other
  misc_feature (249)..(249): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctctatgtgctgacacagccacctcggtgtccgtgtccccaggacagacgccaggatcacctgctctgganatgcattcgaccaaccactattcttatggtaccagcagaagccaggccaggcccctgtgtgttgatatataaagaccactgagacgccttaacgagggtctccctgacgtcgattctctcggctccactcgagggacaagtggtacactattacgacctatcgaggtggggacgtaccgaaggacaaaggaaacgaccggtaggaccttagtaacttatttccgtgtaactaaattcttacagtaacctattaccgttaggttcggttaacttagtcgttaccgttacgggaacgttcgggaaccgttaaaccggg

SEQ ID NO: 322457 - DNA, 531 bp, Homo sapiens
  misc_feature: GZ8MTXP01DWEP0.51.6.A06.1.454.CMB.2.raw
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
  modified_base (481)..(481): a, c, t, g, unknown or other
  misc_feature (481)..(481): n is a, c, g, or t
  modified_base (496)..(496): a, c, t, g, unknown or other
  misc_feature (496)..(496): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtgcagtcgtggggggagcgtggtccagcctgggaggtccctgagactctcctgtgaagcctctggattcagcttcagtacgtatggtttgcgtctgggtccgcctaggctccgaggcaaggggactggcaggtgggtgcagtctatatacatatgaaaagggaaanaanaaataaactacgtacgacgagacgtcgagacggctatacactactacacagacacaacaccaaanaacactacttancanacaatacgaacacctgagtactgacgaactacgntgttactattgttgngacggaaggaggaagatacgactaacgaacgaacg

SEQ ID NO: 322458 - DNA, 538 bp, Homo sapiens
  misc_feature: GZ8MTXP01EA662.51.6.A06.1.454.CMB.2.raw
  modified_base (491)..(491): a, c, t, g, unknown or other
  misc_feature (491)..(491): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgagcctcctatgtgctgacacagcccaccctggtcgtccgtcgtccccaggacagacgccaggactcacctgctctggagatgcattcgacccaacccatattcttatggtacagcagaagccagccaggcccctgtgttgtgatataataaagaccactgagacggtccttacgagggtaactcccgtgacgcgtatttcgtcgtcggcctaccacctcgaagggacaaatcggtcacattgaccatcacgtggggacgtcgagcaagaagacgtaggctgtattattctgtctaacttcttacagtactattacgngttaggtaactttagtcgttcgttcggaacgtgggaaccgtaacggg

SEQ ID NO: 322459 - DNA, 578 bp, Homo sapiens
  misc_feature: GZ8MTXP01AV0L7.51.6.A06.1.454.CMB.2.raw
  modified_base (301)..(301): a, c, t, g, unknown or other
  misc_feature (301)..(301): n is a, c, g, or t
  modified_base (468)..(468): a, c, t, g, unknown or other
  misc_feature (468)..(468): n is a, c, g, or t
  modified_base (561)..(561): a, c, t, g, unknown or other
  misc_feature (561)..(561): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctggggaggtccctgagactctcctgtgaagcctctggattcagcttcagtacgtatggtttgcgtctggggtccnccgaggcctccgaggcaaggggctgcagggtgggtgcatctatatcatatgaaaaggaagcaaataaatactacgacaacgactacccggtaggaaacgggcccgtaattccaaccattacccaccgaagaacgaacaacctacccaaagaaccaactaactttaanctagaccaaatcgaaaccaccctagaacgtacttggaacggtaacacgggttctcgttacttattaagttggttgacggtaaggaggggtaanactcgatcgaacgaacg

SEQ ID NO: 322460 - DNA, 660 bp, Homo sapiens
  misc_feature: GZ8MTXP01DEZZZ.51.6.A06.1.454.CMB.2.raw
  modified_base (308)..(308): a, c, t, g, unknown or other
  misc_feature (308)..(308): n is a, c, g, or t
  modified_base (386)..(386): a, c, t, g, unknown or other
  misc_feature (386)..(386): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggaggcgtggtccagccgtgggagtccctgagctctcctgtgaacgcctctggattcagctcagttacgtagttgggtttcgcggtcgtcggggtcccnccgaggcctacccgaaggcgaaaggggctggcgtaggtgggtggctatctaatactacaagtagtaggaaaagggaanaacaaaataaactacgtacgacaacggtactccggtaggaacgggaccctattacccaacctataccgtaccgaagaacgaaccaaactaccccaaaagtaacctaacgttaaactttataccgttagaaacctaaacgtacgaaaccctaacccgtagaacgtaacgttacggaacggtaaacctcgggaccttaggttacttaagtttacgtttaggcggaacggtaaggggaagggtaacgtacgtacggttactaaccgaacgtaaccgg

SEQ ID NO: 322461 - DNA, 697 bp, Homo sapiens
  misc_feature: GZ8MTXP01BWCXT.51.6.A06.1.454.CMB.2.raw
  modified_base (217)..(217): a, c, t, g, unknown or other
  misc_feature (217)..(217): n is a, c, g, or t
  modified_base (312)..(312): a, c, t, g, unknown or other
  misc_feature (312)..(312): n is a, c, g, or t
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagccaccctcggtgtccgtgtccccaggacagacggccaggatcacctgctcgtgganatgctattccgacccaaccctacttatttacttagttacggtaccagacaagaacgccgacggccgacggtcccttgtgttgttagaataataanaaagacacgtaggaggacggtccttacggagggtaccttcccgtaggacgtacgttactttccgtcgtccggtaccctaccgtaccgtacggaacgggtaaaacctaagttcggtacctaacgtacgttaccggaacctagtacgtagggtacgggtacgtaccggaagggacgaaagggaaacggaccgggaggtcttacgtaactttactttcgtagttactaacgttcttacgaacgtactaagtaccgtaggttacggttaacttgttcgttacgttacggaacgtaacgggaaccgttaggtcccgttacgtcgtacgggttaccaccgacccgaaccggacccctaacccgtctcgttacctaaccgttccgttccccg

SEQ ID NO: 322462 - DNA, 522 bp, Homo sapiens
  misc_feature: GZ8MTXP01B8H8S.51.6.A06.1.454.CMB.2.raw
  modified_base (367)..(367): a, c, t, g, unknown or other
  misc_feature (367)..(367): n is a, c, g, or t
  modified_base (430)..(430): a, c, t, g, unknown or other
  misc_feature (430)..(430): n is a, c, g, or t
  modified_base (471)..(471): a, c, t, g, unknown or other
  misc_feature (471)..(471): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatcacctgctctggagatgcattcgacccaaaccctacttattcttattcggtaccagcagaagccaggccaggcccctgtgttgttgatatataaagacactgagaggccttcgagggatccctgagcgtattctctcggcctccacctcgagggaacaatggtacanattgaccatcgagtggagtccgaggcagaagacgaggctgacttattctagtacaagtcttanagactatcagttgtactatgtctcggaactgggacaggtcncgtctacgttcgcgaccaacggcccaacccactcgactaaccttcgtcccg

SEQ ID NO: 322463 - DNA, 569 bp, Homo sapiens
  misc_feature: GZ8MTXP01CCT9C.51.6.A06.1.454.CMB.2.raw
  modified_base (419)..(419): a, c, t, g, unknown or other
  misc_feature (419)..(419): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaacccattattcttattggtaccagcagaagccaggccaggcccctgtgttgtgatatataaagacactgagacggccttcgagggactcccgtgagcgtattctctcggcctcacctcgaagggaacaagtggtacactattcgaccatcagtgagtaccgaggcaagaagacgaggctagacttagtttcngtacaagttcttacagtacatcgagttggttaacttgtgttacgttcggaacgtcggggaaccaagggttaccaccggttacctacgggttaccacggaccccgaacggacccctaacccctctccgttacctaaccttccgtttccccg

SEQ ID NO: 322464 - DNA, 786 bp, Homo sapiens
  misc_feature: GZ8MTXP01AKKLG.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggaggcgtggtccagccgtgggaggtccctgagactctctgtgagcctctggattcagcttcagttacgtatgggtttgcgtcgtcggggtcccgccgagggcctaccgagggaccgaaagggggtacctgggccgtagggtgggggttcggctattccgtaattatacaagttagtaggaaaaaagggaaacgaacctaaaagttaaaactaccgtaaaccggaccgtaaacgggacccgttacccgggtagggaaaacgggggtccccgtaaactttaccccgaaaccctattaccccgtacccgaaaggaacggaaacccaaaacctaacccccgaaaaaggtaaacccctaaacccgtttaaaccttttaacgtaccttaaccggtaaacctaaaacttaccggaaaaccctaaccccgttaggaaccgttaaccggttagggaaacggggtaaccgtacccgggttacgtttacggttacctttaaacggttttacgttacggggttagggaccgggaagggggtaacgggggtaagtaacggttacgggaacttccccgaagtaacccggg

SEQ ID NO: 322465 - DNA, 571 bp, Homo sapiens
  misc_feature: GZ8MTXP01BYKSS.51.6.A06.1.454.CMB.2.raw
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtgtcccccaggacagacggccaggatcacctgctctggagatgcattcgcccaacccatattcttattggtaccagcagagccaggccaggccctgtgttgtgatatataaagacactgagacggccttgagggatcccgtgacgcgtacttcctctggcctccacctacgagggaacaagtcggtcactattcgaccatcagtggacgtccaggcaaggaagacgaggctgaacttatttctggtctaattctacagacatcgtagttgttacttagttcgttcttaacgggaacgttcggggaaccttaacgggtcccgtaccggttaccgttacggttccaaccgaccccgaaacggccccaaaccccttacgtcgttccgtaacccg

SEQ ID NO: 322466 - DNA, 666 bp, Homo sapiens
  misc_feature: GZ8MTXP01EK1SC.51.6.A06.1.454.CMB.2.raw
  modified_base (349)..(349): a, c, t, g, unknown or other
  misc_feature (349)..(349): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtgtcccccaggacagacggccaggatcacctgctctggagatgctattcgacccaaaccctattattccttaattcggtaccagcagaacgccaggccacggccctgtgttgtgatatataaagacactgagacggtccttacgagggactcccgtgagcgtatttccncgtcggcctcccacctacgagggctaagtcggtcactattcgactatcgagtggacgtccgaggacgaaaggaagacgaggctacgtactttaagtttctagggttactaaattccttacaacgtaaccgtattaccgtaaggtttcggttaaacctttagtacgtttacggttaacgggtaaaccggttacggggtaaacccgttaaacgggtcccgtaaaccccggttccggttaacgggttacccgaaccgggtacccccgaaaccgggtacccccaaaccccgttaccgttccggttaaccccgttaaccccg

SEQ ID NO: 322467 - DNA, 602 bp, Homo sapiens
  misc_feature: GZ8MTXP01ECRT7.51.6.A06.1.454.CMB.2.raw
  modified_base (356)..(356): a, c, t, g, unknown or other
  misc_feature (356)..(356): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagctctggattcagcttcagtacgtatggtttgcgctgggtccgccaggctccaggcaagggactgcaggtggtgcatctatatcaatataggaaaaaggaaanaactaaattaaactaccgacgacaacgaccgttaccggtaggaacgggtaccgtactaccaacctaactccgtaccgaagaacgaacaaactaaccaaagaacctaacgtaactttactactagaactaaatacgaaaccaccgtagtaacgtacgttacggaacggaactacggttcttacgttacgttaagtttagttgttcggacgggaaggagggtaagtacgtacgactaacgaacgaacg

SEQ ID NO: 322468 - DNA, 622 bp, Homo sapiens
  misc_feature: GZ8MTXP01EV633.51.6.A06.1.454.CMB.2.raw
  modified_base (220)..(220): a, c, t, g, unknown or other
  misc_feature (220)..(220): n is a, c, g, or t
  modified_base (492)..(492): a, c, t, g, unknown or other
  misc_feature (492)..(492): n is a, c, g, or t
  modified_base (511)..(511): a, c, t, g, unknown or other
  misc_feature (511)..(511): n is a, c, g, or t
  modified_base (604)..(604): a, c, t, g, unknown or other
  misc_feature (604)..(604): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggactcacctgctcgtgganatgctattcgacccaaaccctacttatttccttattggtaccagcagaagccaggccacggcccctggttgttgtgatataataaagacacgtggaagacggtccttagagggtactccctagagcgtattcctcgtgcctcccaccgtcgaagggaactaagtcggtacactagtttacgacctagtacgaggttcggacgtaccgaggcgaaacggaaggtacgagggtctacggtacttaatttcgtgtactaattcttacgagtaacntacgtagttggttaacttnttcgttcgttaacgggtaaacgttcggggaaccttaacggtcctacccgttacgttcggttaccgaaccgacccgaaccggaccccaaccccngttccgttaacctaaccg

SEQ ID NO: 322469 - DNA, 561 bp, Homo sapiens
  misc_feature: GZ8MTXP01AJWCL.51.6.A06.1.454.CMB.2.raw
  modified_base (363)..(363): a, c, t, g, unknown or other
  misc_feature (363)..(363): n is a, c, g, or t
  modified_base (421)..(421): a, c, t, g, unknown or other
  misc_feature (421)..(421): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgcattcgacccaaacccatatttcttattcggtaccagcagaagccaggccaggcccctgtgttgtgatatataaagacactgagagccttacgagggactcccgtgagcgtattctctcggctccacctgaggaacaagtgcanattcgacatcagtgagtccaggacagaagacgaggctagattattctgtacagtcttnagactatcgagttgttacttgtgttcgttacggtaacgtcgggaaccgttaggtcccaccgttccgttacggaccgacggaccccgtaaaccggcccctaaaccccgtacgttccggacctaaccgttcctttcccccgg

SEQ ID NO: 322470 - DNA, 541 bp, Homo sapiens
  misc_feature: GZ8MTXP01BWWXG.51.6.A06.1.454.CMB.2.raw
  modified_base (352)..(352): a, c, t, g, unknown or other
  misc_feature (352)..(352): n is a, c, g, or t
  modified_base (490)..(490): a, c, t, g, unknown or other
  misc_feature (490)..(490): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgaccacagccaccctggtgtcccgtgtccccaggacagacgccaggatcacctgctctggagatgcatcgaccaacccactattcttattggtaccagcagagccaggccagcccctgtgttgtagatatataaagaccactgagaggtccttacgagggntcccgtgacgcgtattcgtctcggcctccacctcgagggaccaagtcggtacacgtattacgaccatacagtggggactcgaggacagaacgacgagctggtacttatttctgtaactaattcttacagtacattcgngttcggtaacttgtcgtttcgtacgggttaacgtcgggaaccgtaaccggg

SEQ ID NO: 322471 - DNA, 576 bp, Homo sapiens
  misc_feature: GZ8MTXP01B88NQ.51.6.A06.1.454.CMB.2.raw
  modified_base (452)..(452): a, c, t, g, unknown or other
  misc_feature (452)..(452): n is a, c, g, or t
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagccaccctcggtgtccgtgtccccaggacagacggccaggatcacctgctcgtggagatgctattcgaccaaacccattattcttattggtaccagcagaagccaggccaggccctgtgttgtgatataataaagacactgagacggtccttacgaggactcccgtgagcgtattctctcggcctcacctcgaggaacaagtcggacaactattacgacctatcgaagtcggacgtccaggacgaagaaggacgaggctaggacttatttctagtactaagttcttacgaanacatcgagttcgttaacttatgttacgttacggacgtcgggaaccttaggtccaccggttcgtaacggttccgacgacccgaacggacccctaacccgtctacgttacctccttccgttccccg

SEQ ID NO: 322472 - DNA, 530 bp, Homo sapiens
  misc_feature: GZ8MTXP01ESCN4.51.6.A06.1.454.CMB.2.raw
  modified_base (246)..(246): a, c, t, g, unknown or other
  misc_feature (246)..(246): n is a, c, g, or t
  modified_base (336)..(336): a, c, t, g, unknown or other
  misc_feature (336)..(336): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (453)..(453): a, c, t, g, unknown or other
  misc_feature (453)..(453): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaaaccctattattctttangggtaaccagcagaagccaggccaggcccctgtgttgttgatataataaagacactgagaggccttcgagggactccctgagcgattctntcggctcactcgagggaacaatggtacacattcgaccatcacgtggactccgaggcaagaagaacgaggctagacttattcagtacaagttcttananacatctagttaggtacttntgtctacggaatcgggacaagggtcaccgtcaggttcacgacccaaggccccaaccgctcgctaaccttcgttcccc

SEQ ID NO: 322473 - DNA, 662 bp, Homo sapiens
  misc_feature: GZ8MTXP01CF278.51.6.A06.1.454.CMB.2.raw
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (586)..(586): a, c, t, g, unknown or other
  misc_feature (586)..(586): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccaggccgtgggacgtccctgacgactctcctgtgaacgcctctggattcagcttacagttacgtatggtttgcgtcgtcgggtcccgccaggcctccgaggcgaaaggggctggcgtaggtgggtgcatctatactnaagtataggaaaaggaanaactaaaataaaactactaacggacaacggtaccgtcccggtaaggaacgggtacctaattaccaaaccgtataccgtaccgaagaacgaaaccaaacgtaaccccaaaagtaaaccctaaccgttaacttttaacaccttaagaacctaaaagttaccgaaacctaaccccgtgaaacgtacgttagaacgggtaacctaaccgggttnttacgttacgttaagttgttacggcggacgggaagggtaacgggtaacgtacgtacgttaactaaccgaacgaacg

SEQ ID NO: 322474 - DNA, 507 bp, Homo sapiens
  misc_feature: GZ8MTXP01DACMH.51.6.A06.1.454.CMB.2.raw
  modified_base (297)..(297): a, c, t, g, unknown or other
  misc_feature (297)..(297): n is a, c, g, or t
  modified_base (350)..(350): a, c, t, g, unknown or other
  misc_feature (350)..(350): n is a, c, g, or t
  modified_base (462)..(462): a, c, t, g, unknown or other
  misc_feature (462)..(462): n is a, c, g, or t
tcagcgatcgtatacacgaccggtgctcgatttagatctactgacaggggtctgggagacgagcccagcactggaagtcgcctgtgtttccattcggtgatcatcactgaacacagaggactcaccatggagtttgggctgagcttggggttttcctcgttgcttcttttaagaggtgtccagtgtcaggtgcagctggtgcagtctgggggagcgtggtccagcctgggacgtcctgagactctcctgtgaagcctctggattcagcttcagtacgtatggtttgcgctgggtccncaggctcgaggcaaggctgcaggtgggtgtatctatatcatatgaaaagggancaaataaatactacgcagactcgtagaggcgatcacatctccagacgacaactaccaaagacactaactttatactagacaaatcgaacaccctgacattcgagaacacggntgttctattgttgttgacgaaggaggtaacgatcggatcgcgaag

SEQ ID NO: 322475 - DNA, 608 bp, Homo sapiens
  misc_feature: GZ8MTXP01C085D.51.6.A06.1.454.CMB.2.raw
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggaggcgtggtccagccgtgggacggtccctgagactctcctgtgaacgcctctggattcagcttcagtacgtatggtttgcgtcgtcgggtcccncgaggctccgaggcgaagggctgcgaggtgggtgcatctaatatcatataggaaaagaancaaaataaatactaacgacaagactccggtagaacgggcctattccaacctatacctaccaagaacgaacaaactacccaaagaaacctaacgttaactttaatacctacgaaacctaaaactcgaaacctacccgtagaacgtacttaggaacggtaaccacgggttcttagttacttaaagttagtttggcggacggaaggaagggggtaatacgtacggaactaaccgaacgtaaccgg

SEQ ID NO: 322476 - DNA, 675 bp, Homo sapiens
  misc_feature: GZ8MTXP01A7Y2Q.51.6.A06.1.454.CMB.2.raw
  modified_base (626)..(626): a, c, t, g, unknown or other
  misc_feature (626)..(626): n is a, c, g, or t
  modified_base (645)..(645): a, c, t, g, unknown or other
  misc_feature (645)..(645): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagctggtgcaggtcggtgggggaggcgtggtccaggccgtggggacgtccctgacgacttctcgtgtcgaagtcctgtggtacttcagtcttacgaggttacgtagttgggtttcgccggtcgttcggggtcccgccgacggtcctaccggaaggacgaaagggggtctgggacgtagggggttggggtcgactacgttacttaacttatacgaaagttaagtaagggaaaaaagggaaactaacaaaattaaaaccgttaccgtaacgacgaaggtacccgtaccggtaaggaacgggaccttaagtaccaacctacttacccgacgaaacgaaccaacaaaccaacccaaataacctaacttaactttacacgtacaaactaaagaccgaaacctaccgtagaacgtacgtaggaacgtaacgaacggttnttagttacgttagtgttgngaggaaggaggcagcactaacgaacgaacg

SEQ ID NO: 322477 - DNA, 682 bp, Homo sapiens
  misc_feature: GZ8MTXP01BYKWW.51.6.A06.1.454.CMB.2.raw
  modified_base (320)..(320): a, c, t, g, unknown or other
  misc_feature (320)..(320): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgcattcgccaaccatattcttattggtaccagcagagccaggccaggccctgtgttgtgatatataaagacactgagacgccttcgagggactccctgacgngattctctcggcctccaccgtcaggggaaccaagtcggtacaacgtatttcgaacccaagttccgaaggttcgggaacgtcccgaaggggaccaaaggaaacggaaccggtaaagggcccttagggaactttaacgtttctacgttacctaaacgttccgtttaacaaacgaacctaattaccgtaaggtttacgggtttaaacctttaagttcggttaccttttaccggggaaacgttaacggggtaacccgttaaagggttcccgttaacccggttacccgtaagggttacccgaacgaccccgaaaccgggaccccaaacccccggtactccgttacctaaccttcccgtttaaccccg

SEQ ID NO: 322478 - DNA, 591 bp, Homo sapiens
  misc_feature: GZ8MTXP01BQNVL.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagactctctgtgaagcctctggattcagcttcagtacgtatggtttgcgcgtgggtccgccgaggctccgaggcaaggggactggcgaggtgggtcggcagtctatatcatatgaaaaggaagcaaataaatactacgcagactccgtagaagggcgattcacatactaccagacgacaactacccaaagaaccaactactttactacctagtaacaaactacgaaacctaccccgtagtaacgtaacgttacggacggtaaccgaacgggttcttacggttactttaagtttagttcgggttggacgggaagggaaggggtaacgtagttacggacgtaacaacgtaacccgg

SEQ ID NO: 322479 - DNA, 725 bp, Homo sapiens
  misc_feature: GZ8MTXP01B39F8.51.6.A06.1.454.CMB.2.raw
  modified_base (306)..(306): a, c, t, g, unknown or other
  misc_feature (306)..(306): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggaggcgtggtccagccgtgggagtccctgagactctcctgtgacgcctctggattcagcttcagttacgtattgggtttgcgtcgtcgggtcccnccgaggcctccgaggcaagggctgcaggtgggtgcatctaatatacatagtaggaaaagaagctaaaataaactacctaacgacaaggtaccgtaccggtaggaaacggggtccctaattccaacctactaccgtaccgaagaacgaacctaaacctaccccgaaaagtaaacccctacgttaaacctttttaactacctaacggtaaacctaaaaacgttaccggaaaaccccttaaacccccgtagggtaaaccggttaaaccgtttaacgggggaaaccgggtaaacccgaaccgggttaccgtttacgggtttaacccttttaaagttttagggttacgggttacgggaaccggggaaaggggtaacgggggaagtaacgttaccgggaacttaacccgaaccggtaaacccggg

SEQ ID NO: 322480 - DNA, 541 bp, Homo sapiens
  misc_feature: GZ8MTXP01A3RH2.51.6.A06.1.454.CMB.2.raw
  modified_base (434)..(434): a, c, t, g, unknown or other
  misc_feature (434)..(434): n is a, c, g, or t
  modified_base (503)..(503): a, c, t, g, unknown or other
  misc_feature (503)..(503): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggagtccctgagctctcctgtgaagcctctggattcagcttcagtacgtatgggtttgcgcgtgggtcccgccgaggctccgaggcgaaagggctgcaggtgggtgcagtctatatcatatggaaaagaagcaaataaagctacgcagactcgtgaaggcgatcacatactcagagacaaactacccgaaataacactaactttanactagaacaaatcgaaaccaacccgtgacgtacttcgaaggaacacggctgttacttagttagttaggngacggaaggagggaagtacgtacgatccgaacgtaacg

SEQ ID NO: 322481 - DNA, 485 bp, Homo sapiens
  misc_feature: GZ8MTXP01DGI1X.51.6.A06.1.454.CMB.2.raw
  modified_base (322)..(322): a, c, t, g, unknown or other
  misc_feature (322)..(322): n is a, c, g, or t
  modified_base (358)..(358): a, c, t, g, unknown or other
  misc_feature (358)..(358): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttatggtaccagcagaagccagccaggcccctgtgttgtgatatataaagacactgagaggccttcgaggatccctgagcgattcnctcggctcactcaggaacaatggtcacattgaccancagtgagtccaggcagaagacgaggctgactattctgtcaattcttcagacatcagtgtactatgtctgactggacaggtcacgtctaggttcacgccaagaccaacccgctcgctaacttcgtccc

SEQ ID NO: 322482 - DNA, 566 bp, Homo sapiens
  misc_feature: GZ8MTXP01B5D9B.51.6.A06.1.454.CMB.2.raw
  modified_base (214)..(214): a, c, t, g, unknown or other
  misc_feature (214)..(214): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctgganatgctattcgcccaaaccacttattcttattggtaccagcagaagccagccaggcccctgtcgttgttgatataataaagacactgagaggccttcgagggactcccgtgagcgtatctcgtcggctcactcgagggaacaatggtcacattcgacatcgagttggagtccaggcagaagacgaggctgacttattctgtacagtcttcgaagactatctagtggtaacttgtgttcgttacggaacgtcgggaaccgttaaggttccaccggttaccgttagggttaccgcgacccgtaaacggcccctaaacccgtacgttcggttacctaaccgtttccgtttcccccg

SEQ ID NO: 322483 - DNA, 598 bp, Homo sapiens
  misc_feature: GZ8MTXP01ATTC9.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgaccaaaccctattattcttattggtaccagcagaagccaggccaggcccctgtgttgttgatatataaagacactgagaggccttacgagggtactcccgtgagcgtattctctcggcctccacgtcagggaacaagtcggtcactattcgaccatcgagtggagtccgaggcaagaagacgagctgacttatttctgtacaagttcttacaagtactatcgtaggttggttaaccttagttcgttacgttaccgggaacgttcggggaaccttaacgggtccttacccgggtaccgtaagggttacccgaccggaccccggaaaccggacccccaaaccccgtactcggttaccctcccgttccgttccccgg

SEQ ID NO: 322484 - DNA, 707 bp, Homo sapiens
  misc_feature: GZ8MTXP01DWRXD.51.6.A06.1.454.CMB.2.raw
  modified_base (687)..(687): a, c, t, g, unknown or other
  misc_feature (687)..(687): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggtttttcctcgttgcttcttttaagaggtgtccagtgtcaggtgcagctggtgcaggtcgtgggggaggcgtggtccagccgtggggagtcctgagactctctgtgaagcctctggattcagcttcagttacgtagtggtttgccgtcgtcgggtcccgccgaggcctccgaagggcgaaagggggactggacgaggtggggtggctatctaatatcgaattagtaggaaaaaggaagaacaaaattaaaacgtaactaaccgggacaaacgggtaccgttacccggtagggaaacgggggtaccccgtaatttacccgaaacctaacgtttacccctacccgaaaagggtaaccggaaaacccaaaaccgttaaaccccccaaaaaggttaaaacccctaaaccgtttaaacttttttaactacctttacggaaacctaaaacgttacgaaaccctaaccccgttagaacgtaccgttagaacgggaactacgggttcttagttacttaagtttagttggcgttacgaaggagggaanacgtcgataacgaacaacgg

SEQ ID NO: 322485 - DNA, 605 bp, Homo sapiens
  misc_feature: GZ8MTXP01EW93E.51.6.A06.1.454.CMB.2.raw
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
  modified_base (447)..(447): a, c, t, g, unknown or other
  misc_feature (447)..(447): n is a, c, g, or t
  modified_base (498)..(498): a, c, t, g, unknown or other
  misc_feature (498)..(498): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgtcttcttttaagtaggtgtccagtgtcaggtgcagcgtggtgcgaggtcggtgggggagggcgtcggtccgagccgtgggtaggtccctgagactctcctgtgaagcctctggattcagcttcgagtacgtagttggtttgccgcgtacgggtccgccgaggctccgaggacgaaggggactgcgtagggtggtggcatctatatnaatatacggaaaagggtaanctaaaataaactactacgaccaagaccgtcggtagaggccgtaatccaacatcctacganaacgacaaactaacccaagaaactacctaattttacactacgaaactaaanacgaaaccctaccgtaggtaagaccttagggaaggaaacctccgggttattcgttacttaagttacgttgggcgaggaaagggtgaacgtataccgagtcaacgaag

SEQ ID NO: 322486 - DNA, 617 bp, Homo sapiens
  misc_feature: GZ8MTXP01BOAOO.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgctattcgacccaaaccctacttattcttattcggtaccagcagaacgccaggccaggccctgtgttgtgatataataaagacactgagacggccttcgagggactccctgacgcgtattctcgtcggcctccacctcgagggaaaccagtcggtacacgtattacgacctagtcgaggttcggacgtaccgaggacaagaacggacggaggctagtacttatttcgtagtactaaagttcttacgaatactatcgagttcggttaacttagttcgttacttacgggaacgtaacggggtaaccgttaaacggtccgaccgttaccggtaggttaccaccggaccccgaacgggacccctaaacccgtacttcgttacctaaccgttccctttaaccccg

SEQ ID NO: 322487 - DNA, 564 bp, Homo sapiens
  misc_feature: GZ8MTXP01AS09M.51.6.A06.1.454.CMB.2.raw
  modified_base (182)..(182): a, c, t, g, unknown or other
  misc_feature (182)..(182): n is a, c, g, or t
  modified_base (227)..(227): a, c, t, g, unknown or other
  misc_feature (227)..(227): n is a, c, g, or t
  modified_base (257)..(258): a, c, t, g, unknown or other
  misc_feature (257)..(258): n is a, c, g, or t
  modified_base (261)..(261): a, c, t, g, unknown or other
  misc_feature (261)..(261): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttcgcgtagcgtctttaagaggtgtcagtgtnaggtgcagctggtgcagtcgtgggggaggcgtgtcgagccgtggnggtcctgagctctctgtgagctctggatcnnctntagtagtgtgtgcgtcgtcggcgcgcgcgcgagacgagcgngngnggtggtgntatatactatatagtagtagaaagaagaactaaataaactacgtacgacgacgtacgtacgtacgacgtacgtactacactactactacgacgacaacaacaacaacgaactaacgtacttactactacgtaactaacgtaacgaaccgtacgtacgtacgtacgtacgagtaacgtacgttacgtacgttagttagttagttagttcgacggaaggaggtaacgtagtacgttacgtaacgaacgaacg

SEQ ID NO: 322488 - DNA, 653 bp, Homo sapiens
  misc_feature: GZ8MTXP01CMWP2.51.6.A06.1.454.CMB.2.raw
  modified_base (258)..(258): a, c, t, g, unknown or other
  misc_feature (258)..(258): n is a, c, g, or t
  modified_base (376)..(376): a, c, t, g, unknown or other
  misc_feature (376)..(376): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctggggttttcctcgttgctcttttaagaggtgtccagtgtcaggtgcagctggtgcaggtcgtgggggagcgtggtccagccgtgggagtcctgacgactctctgtgacgcctntggattcagcttcagtacgtatgggtttcgcgcgtgggtcccgccagggcctcgaggcgaaggggctggcgagggtgggtgacattcgtaatagtcaagtagtaggaaaaagggaacncaaaattaaaacgtacctaacggcaaaggtaccctacccgggtaggaaacggggccctaattaccaaccctattcctacccgaagacgaaaccaactacccgaaagtaccaaccgttaaccttttatacctaggaacctaaaagtccgaaacctacccgtagaacgtaaccgtttggaaaccggtaacaaccggggctttacggttactttaaagtttagttcgggttggaccggtaagggagggtaacgtacgttacggacttccgaacgaaccgg

SEQ ID NO: 322489 - DNA, 732 bp, Homo sapiens
  misc_feature: GZ8MTXP01D9RXP.51.6.A06.1.454.CMB.2.raw
  modified_base (310)..(310): a, c, t, g, unknown or other
  misc_feature (310)..(310): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggagcgtggtccaggccgtgggacgtcctgacgactctctgtgaacgcctctggattcagtcttcgagttacgtagttggtttgcggcgtcgggtcccnccgaggcctccgaggacaaggggactggcgtagggtggggtcgctagtctaatatacaagtagtaggaaaaaagggaacgtaactaaaattaaaactaccgtaccggacgtaacggtaccgttacccgggtagggaaacggggcccgtaaactttacccgaaccctaacgttacccgttaacccgaaaggtaaccggtaaacccaaaaccgttaacccccaaaaagtaaaacccctaaaccgtttaaacctttttaacgtaccttaacggaaacctaaaacgttaccggaaaccctaaccccggttagaaacgtacgttacggaaacgggtaactaccggggttactttaggttaccttaagtttaacgttggttcggacgggtaagggagggaacggtactacggactaacgaacgaacgg

SEQ ID NO: 322490 - DNA, 595 bp, Homo sapiens
  misc_feature: GZ8MTXP01ERFDQ.51.6.A06.1.454.CMB.2.raw
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (447)..(447): a, c, t, g, unknown or other
  misc_feature (447)..(447): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttcgcgtaggctctttaagaggtgtccagtgtcaggtgcagctggtgcagtcgtggggggagcgtggtccagcctggggaggtccctgagactctcctgtgaagcctntggattcagcttcagttacgtattggtttgcgcgtgggtcccnccgaggcctccgaggacgaaggggctggcgtagggtgggtgcatctatatcattanaggaaaaaggaanaactaaataaactactacgacaacgacgtcggagacggcctatacactatacctacgagacaacaactaaccgaaanaacctacttaactttacaccgtacgaactaactaacgaacctacctacgtacgtacgtacgaacggaacgtacgttacgtacgttacgttagttagttagttggttacggaagggagggaagtacgtacgttacgtaacgaacgaacg

SEQ ID NO: 322491 - DNA, 604 bp, Homo sapiens
  misc_feature: GZ8MTXP01C4WCJ.51.6.A06.1.454.CMB.2.raw
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtgggggaggcgtggtccaggcctgggaggtccctgagactctcctgtgaagcctctggattcagcttcagtacgtatggtttgcgtctgggtcccgccaggcctccgaggcaaggggctggcgaggtgggtgcatctatatcatangaaaaggancaaataaatactacgcagactccgtagaagggccgattcaccatctaccagacgaacaaactacccaaagaaaccactaactttaatcttacgaactaaaacgtcgaaacctaccccgtagtaacgtaaccgttgggaaacggtaaccgtaacgggttcttacggttaccttaacgtttagtttacggttggttaccggaaggggaggggtaagtaacgtccggaacttccgaacgtaaccgg

SEQ ID NO: 322492 - DNA, 647 bp, Homo sapiens
  misc_feature: GZ8MTXP01B42BE.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagctctcctgtgaagcctctggattcagcttcagtacgtattggtttgcgtcgttggggtcccgccgaggctccgaggccgaaaggggctggcgaggtgggtggcattctaatactcaatataggaaaaaggaagtaacaaaattaaactaccgtaacgactaaggacctacccgggtaggaaacggggtccgtaacttaccaaccctattaccctacccgaagaacgaaccaaactaccccgaaagtaaaccaaccgttaactttttaacgtccttaacgacctaaaacgtacgaaacctacccctagaaccgtacgttacgacgggaaccgtaacggttcttacgttcttaagttagttggttcggacggaaggtagggaacgagttacggactaacccgaagaaccgg

SEQ ID NO: 322493 - DNA, 528 bp, Homo sapiens
  misc_feature: GZ8MTXP01AGPBN.51.6.A06.1.454.CMB.2.raw
  modified_base (429)..(429): a, c, t, g, unknown or other
  misc_feature (429)..(429): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggaggtccctgagactctcctgtgaagcctctggattcagcttcagtacgtatggtttgcgctgggtcccgccaggctccgaggcaaagggctggcaggtgggtgcatctatatcaatatgaaaaggaagcaaataaatactacgcagactcgtagaaggcatcacatctcagagacaactaccaaagaacactactttanctagacaaatcgaacacccgtgacgaccgttgaacgtaacgacggttctgttctaattagttgttgcgtaagggaggaacgagtcgatcgaacgaacgg

SEQ ID NO: 322494 - DNA, 583 bp, Homo sapiens
  misc_feature: GZ8MTXP01CQ6UL.51.6.A06.1.454.CMB.2.raw
  modified_base (215)..(215): a, c, t, g, unknown or other
  misc_feature (215)..(215): n is a, c, g, or t
  modified_base (438)..(438): a, c, t, g, unknown or other
  misc_feature (438)..(438): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattgaccaaaccatattcttattcggtacagcagagccaggccaggccctgtgttgttgatatataaagacactgagacgcttcgaggactccctgagcgtattctctcggctaccactcgaggaacaagtggtcaacattcgaccatcgagtggagtaccgaggcaaggaaacgacgacgggtctaggtacttacttcgtgttactaagtttccttanaagtactatcgtaggttaggttaacttagtgttaccgttacggaacgtaacggggtaaaccagggttaccaccggttaccgtacggttacgacgacccgtaacggaccctaaccccgacgtcgttccgtaaccttcgttccccgg

SEQ ID NO: 322495 - DNA, 680 bp, Homo sapiens
  misc_feature: GZ8MTXP01EA3TE.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccagccgtggggacgtccctgacgactctctggtcgaacgcctcgtggacttcagcttacgagttacgtagttgggtttcgccgtcgttcggggtccccgaccgtagggtcctacccggaagggtaccgaaagggggtctggacggtagggtgggggtcgactatacttaactactcaagtaagtaggaaaaaagggaactaactaaaataaaacgttaccgacgaacgtaagggtacccgttaccgggtaggaaacggggtaccctattaccaacctattacccaccgaagaaccgaactaaaccaacccaaaagtaacctaacgttaaccttttaagacctaacgaaactaaacgtacgaaacctacgtagtaacgtacgtacgaacgtaacgtcgttatacgttactaagttgttggcgacggaaggtacggaagtacgtacgatcgaacgaacg

SEQ ID NO: 322496 - DNA, 639 bp, Homo sapiens
  misc_feature: GZ8MTXP01B8CU1.51.6.A06.1.454.CMB.2.raw
  modified_base (259)..(259): a, c, t, g, unknown or other
  misc_feature (259)..(259): n is a, c, g, or t
  modified_base (297)..(297): a, c, t, g, unknown or other
  misc_feature (297)..(297): n is a, c, g, or t
  modified_base (613)..(613): a, c, t, g, unknown or other
  misc_feature (613)..(613): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccaggccgtgggagtccctgagactctctgtgagcctcngattcagctgagtacgtagtggttgcgtcgtgggcccncgaggctccgaggcaagggctgcgagggtgggtgctagtctaatagtctaataagtggaaaaaaggaactaactaaaaattaaaacgtacctacggactaacgtaccgtacccggtaggaaacgggtcccgtaacttacccaacctactcctacccgaagaacgaaccaaactaccccaaagaaaccctaactaacttttagaccttagaacctaaaacgtacgaaacctaacccgttaggaacgtaaccgttagggaacggtaaccgaacggttcttagttactttaagtacgtttgcgagggtaaggtaagggngtactacggaactccgaacgtaaccg

SEQ ID NO: 322497 - DNA, 548 bp, Homo sapiens
  misc_feature: GZ8MTXP01ASEV9.51.6.A06.1.454.CMB.2.raw
  modified_base (356)..(356): a, c, t, g, unknown or other
  misc_feature (356)..(356): n is a, c, g, or t
  modified_base (446)..(446): a, c, t, g, unknown or other
  misc_feature (446)..(446): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgaagcctctggattcagcttcagtacgtatggtttgcgcgtgggtcccgccaggctccgaggcaaggggctggcaggtgggtgcagtctatatcatatggaaaaggancaaataaatactacgcaagactccgtagaacggccgattccgaccatccgtaccagacgaacaactacccaaagaaccaactacttttancctagacaaatcgaaccaccctgacgtacttggacggaacgtacggcttagttcttaattgttgttggacgaaggagggaagacgtcggactcgaacgaacg

SEQ ID NO: 322498 - DNA, 591 bp, Homo sapiens
  misc_feature: GZ8MTXP01CZ7L3.51.6.A06.1.454.CMB.2.raw
  modified_base (375)..(375): a, c, t, g, unknown or other
  misc_feature (375)..(375): n is a, c, g, or t
  modified_base (464)..(464): a, c, t, g, unknown or other
  misc_feature (464)..(464): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtggggggaggcgtggtccagccgtgggaggtccctgagactctcctgtgaagcctctggattcagcttcagttacgtatggtttgcgcgtcggggtcccgccaggcctccgagggcaaagggggctgcgagggtgggtggcatcgtatatcatagtagaaaagggtaanctaaaataaatactacgacaagactccgtagaacggccgattcacctatctaccagacgaacaaactacccaaagaaccactactttanctagaccaaatcgaaaccaccctgtaacgtacgttagacggaacacgggttcttgttacttaagtttagttggttggacggaaagggaggggaagtaacgtacggttaactaaccgaacgtaaccgg

SEQ ID NO: 322499 - DNA, 672 bp, Homo sapiens
  misc_feature: GZ8MTXP01BY72C.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacgccaggatcacctgctctggagatgcattcgacccaaaccctacttattcttattgggtaccagcagagccaggccaggcccctgtgttgtgatatataaagacactgagacggccttcgaggtactcccgtagacgtacgtattctcgtcggcctaccaccgtcgaacgggaaaccaagttcggtacaaacgtactttacggaacctagtacgaggttacggaacgtacccgaagggaccgaaaggaaacggttaaacgggacgggtacttacgggtaaccgtttaaacgtttcctagttaacctaaacgttcctttacggtaaacgaacctattaccgtaaggtttggttaactttaagtcggttacgttacgggtaaacggtcgggaacgttaacggtaccgacccggttacgtaacggttcgaccgaccccgaacggaccccaacccgtactcggttacctccgttccgttccccg

SEQ ID NO: 322500 - DNA, 673 bp, Homo sapiens
  misc_feature: GZ8MTXP01AF2I8.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctcgtggagatgcattcgacccaaacctacttattcttattggacccagcagaagccaggccaggcccctgtgttgttgatataataaagacactgagacggccttcgaggactccctggagcgtattctcgtcggccttccaccgtcgaggggaaccaagtggtaccactattacgacctagtcgaggttcgggacgtcccgaagggccgaaagggaacgacgggaacggtcgtacggtaacttaacgtttctacggttaccctaaagtttccttaccgaggtaacctaattccgtaggttacggtttaacttaacggttcggttaccgttacggggaaaccgtttcggggaaacccgttaaacgggtcccgttaacccggttccggtaacgggttacccacggaccccgaaacgggaccccctaaaccccgtctaccggttcctaacccgtttccgttcccccgg

SEQ ID NO: 322501 - DNA, 563 bp, Homo sapiens
  misc_feature: GZ8MTXP01BVLNG.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattcgcccaaaccctactattcttattcggtaccagcagaagccaggccaggccctgtgttgttgatatataaagacactgagaggtccttcgagggactcccgtgagcgtattctcgtcggctccacctcgagggaaccaatggtacactattcgaacctatcgagttcggagtcccgaggcaaggaagacggagctgacttattctagtcagtcttcagactatcagttggttacttagtgttcgttacggaacgtcgggaaccttaaggtccaccgttctacggttccgacgccccgaaggaccccaaccccgtcgtcgttacctaaccttccgtttccccg

SEQ ID NO: 322502 - DNA, 705 bp, Homo sapiens
  misc_feature: GZ8MTXP01BG8QW.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttcgcgtaggctctttaagaggtgtcagtgtcaggtgcagctggtgcagtcgtgggggagcgtggtccagcctgggagtcctgagctctcctgtagacgcctgtggattcagcttcagtacgtagttggtttgccgtcgtcgggtcccgcgacggcctcccgaaggggaccgtaaagggggccttcggggacggtagggtgggtcggtacgtacgtacgttaactatacgtaagtaagtaaggtaaaagggtaaagaacgtaaaagtaaacgtaaacgtaacgtacgaacgtaccgtaccggtacggtaacgggtaccgtacgtacctaacctaccgtaccgtaccgaacgaaacgaaaccgtaaacctaaccgaaacgtaaacgtaacgttaacttacgttactacgtaacctaaacgtaaccgtaaccgtaaccgtacgtaacgtaacgtacggaacggtaacggtaacggttacgttacgttacgttaagttagttacggttcggttacggaacggtagggtaaggtacgtacgttacgtaacgaacgaacg

SEQ ID NO: 322503 - DNA, 553 bp, Homo sapiens
  misc_feature: GZ8MTXP01A01ZE.51.6.A06.1.454.CMB.2.raw
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgacccaacccatattcttattggtaccagcagaagccaggccaggcccctgtgttgtgatatataaagacactgagaggccttcgagggactcccgtgacgcgtattctctcggctccacctcgagggaaccaagtcggtcactattgaccatcagtggagtccaggacagaagacgagctgacttagtttcngtacaagttcttanagactatctagttggtacttagtgtacttacgggaacgttaagggaccttaaggtccaccgttccgtaggttccgacgacccaacggcccaacccctactcgttacctaacgttctttccccg

SEQ ID NO: 322504 - DNA, 519 bp, Homo sapiens
  misc_feature: GZ8MTXP01AXQ34.51.6.A06.1.454.CMB.2.raw
  modified_base (416)..(416): a, c, t, g, unknown or other
  misc_feature (416)..(416): n is a, c, g, or t
  modified_base (434)..(434): a, c, t, g, unknown or other
  misc_feature (434)..(434): n is a, c, g, or t
  modified_base (476)..(476): a, c, t, g, unknown or other
  misc_feature (476)..(476): n is a, c, g, or t
  modified_base (501)..(501): a, c, t, g, unknown or other
  misc_feature (501)..(501): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgaccaacccatattcttattggtaccagcagaagccaggccaggccctgtgttgtgatatataaagacactgagaggccttcgagggactcccgtgagcgattctctcggctcactcgaggaacaatggcacgtattgaaccatcgagtggagtccaggcaggaagacgaggctgacttattcagtcaatcttanagacatcagttgtacttntcgtcttcggaatgggaccaagggtccaccgtactaggttcncgccccaaggccccaacccacgtcncctaaccgttcgttcccg

SEQ ID NO: 322505 - DNA, 537 bp, Homo sapiens
  misc_feature: GZ8MTXP01DNCNO.51.6.A06.1.454.CMB.2.raw
  modified_base (305)..(305): a, c, t, g, unknown or other
  misc_feature (305)..(305): n is a, c, g, or t
  modified_base (346)..(346): a, c, t, g, unknown or other
  misc_feature (346)..(346): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (483)..(483): a, c, t, g, unknown or other
  misc_feature (483)..(483): n is a, c, g, or t
  modified_base (501)..(501): a, c, t, g, unknown or other
  misc_feature (501)..(501): n is a, c, g, or t
  modified_base (519)..(519): a, c, t, g, unknown or other
  misc_feature (519)..(519): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcaggtcgtgggggagcgtggtccaggccgtggggacggtccctgagactctcctgtgaacgcctctggattcagcttcagtacgtatggtttgcgcgtgggtcccnccgaggctccgaggcaaaggggctgcaggtggtgcatctanatnatangaaaaggaancaaataaanactacgcaagactcgagaaggccgatcacatctaccaagacgacaacaccaaagaaccactaactttacnctanaccaaaatcgaacacctagatactgaacgaacacggntgttcgtattaagttggngacggaaggaggaagaanacgactaacgaacgaacg

SEQ ID NO: 322506 - DNA, 624 bp, Homo sapiens
  misc_feature: GZ8MTXP01CJ5N8.51.6.A06.1.454.CMB.2.raw
  modified_base (304)..(304): a, c, t, g, unknown or other
  misc_feature (304)..(304): n is a, c, g, or t
  modified_base (376)..(376): a, c, t, g, unknown or other
  misc_feature (376)..(376): n is a, c, g, or t
  modified_base (556)..(556): a, c, t, g, unknown or other
  misc_feature (556)..(556): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccagccgtggggacgtccctgagactctcctgtgaagcctctggattcagcttcagtacgtatggtttgcgctggggtcccnccgaggcctccgaggcgaaggggactggcagggtggggtgactagtctaatatcaatataggaaaaaggaancaaaattaaatacgtacgcaacggtacctacccgggtaggaaacggggtcctaaattccaaccctagtcctaccgaagacgaaacaactaccccaaagaaacacgttaactttatctacgaacaaagtacgaaacctaacccgtagaacggtaccttgggaacggtaaccgaccgggttntacggttacttaagttagttggttggacgtaaggggagggaagtacgtccggaatcccgaagaaccgg

SEQ ID NO: 322507 - DNA, 694 bp, Homo sapiens
  misc_feature: GZ8MTXP01EQJNQ.51.6.A06.1.454.CMB.2.raw
  modified_base (301)..(301): a, c, t, g, unknown or other
  misc_feature (301)..(301): n is a, c, g, or t
  modified_base (383)..(383): a, c, t, g, unknown or other
  misc_feature (383)..(383): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtggggacgtccctgagactctctgtgagcctctggattcagcttcagttacgtatggtttgccgcgtgggtcccncgaggcctccgaggcaagggggctggacgtaggtggggtcgacaattctaatactacaagtaagtaggaaaaaagggtaaanaactaaaagttaaaactaccgtaacgacgaacggtaccgtacgggtagggaacgggaccgtaacttaccaaccgtacttacccgtaaccgaaggaaccgaaacctaaaccgtaaccccgaaaagtaaacccctaacgtttaaacttttaacgtaccgtaacgaaacctaaaacgtaccgaaacccgtaaccgtagtaacgtaacgtacggaacggaaccgtacggttcgttacgttacgtttagtttaacgttcggttcggaacggtaagggaagggtaagtacgtacggttaactaaccgaacgtaaccg

SEQ ID NO: 322508 - DNA, 679 bp, Homo sapiens
  misc_feature: GZ8MTXP01C8CE2.51.6.A06.1.454.CMB.2.raw
tcagcgatcgtatacacgaccggtgctcgatttagatctactgacagggggtgggtccaggaggcagaactctgggtgtctcaccatggcctggatccctctacttcctcccctcctcactctctgcacaggctctgaggcctctatgtgctgacacagccaccctggtgtccgtgtccccaggacagacggccaggatcacctgctctggagatgctaattcgacccaaaccctattattcttaattcggtaccagcagaacgccaggccacggccctgtgttgtgatataataaagacactagagacggtaccttagacgggtactcccgtaggacgtcgtattccgtcgtcggcctaccaccgtcgaagggtaaacctaagttcggtactaactaacttacggaaccctaagtccgtaacggttagggaacgttacccggaaagggaccgaaacggaaaggtaaacccggaagggtcctaagggtaacctttaaactttcggttagttaaccctaagtttacccggtttaaacgaacgtaacgtaacgttacgttaacggttacggtttaacgtttacgttacgttacggttacggtaacggtaacggtaacgttaacgtacgttaccgtacgtacgacgcgaccgaaccgaccaaccactcttactcttccgtcc

SEQ ID NO: 322509 - DNA, 551 bp, Homo sapiens
  misc_feature: GZ8MTXP01BW82I.51.6.A06.1.454.CMB.2.raw
  modified_base (299)..(299): a, c, t, g, unknown or other
  misc_feature (299)..(299): n is a, c, g, or t
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (431)..(431): a, c, t, g, unknown or other
  misc_feature (431)..(431): n is a, c, g, or t
  modified_base (457)..(457): a, c, t, g, unknown or other
  misc_feature (457)..(457): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctggggaggtccctgagactctcctgtgaagcctctggattcagcttcagtacgtatggtttgcgcgtgggtccnccaggctccgaggctaaaggggctgcaggtgggtagcatctaatatcaattanagaaaagggaaanaacaaaataaacgtactacgacaagactcgtagacggcatcacatcacagacaacaacaccgaaanaactactaactttagctagaacaaanaacaaccaacctacgtagtacgtagaggaacgacgttcgtgttagttattagttgttggacggaaggaggaagagtacgactaacgaacgaacg

SEQ ID NO: 322510 - DNA, 811 bp, Homo sapiens
  misc_feature: GZ8MTXP01EUGOC.51.6.A06.1.454.CMB.2.raw
  modified_base (306)..(306): a, c, t, g, unknown or other
  misc_feature (306)..(306): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgagtcgtgggggagcgtggtccagccgtgggagtcctgagactctcctgtgacgcctctggattcagcttacgagttacgtagttggttgcgtcgtcgggtcccnccgaggcctccgaggtacgaagggggtactgggacgtagggtgggggtcgactagttaccttaagtattacaagttaagtagggaaaaaaacgggaaacaacctaaaattaaaaacgtaccctaaaccgggaccgtaaacgggtaacccgttaccccgggttaagggaaaccggggtacccgttaaacgtttacccgaaacccgtaacgttaccccttaacccgaaagggtaaaccgtaaaacccaaaaccttaaccccccgaaaaaaggtaaacccctaaaccgtttaaacgtttttaaactaccgttaacgaaacctaaaacgttaccggaaaaccctaccccgttaggaaacgttaccggttacggaaaccgggaaccgtacccggttagttaaccgtttacgttaaacgttttaacggttcgggttacgggttacgggaaagggggtaacgggtaacggtaacggtacccgggttaaacgtaacccggttaacggtaaccg

SEQ ID NO: 322511 - DNA, 708 bp, Homo sapiens
  misc_feature: GZ8MTXP01CDDC7.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgccaaccatattcttatggtaccagcagagcagccaggccctgtgtgtgatatataaagcatgagacggccttacgagggactcccgtgagcgtacttctcgtaccggcctaccacccgtcgaacggggtaaaccaaagttcgggtacaaaccgtagtttacgaaccctaagttaccgaagggttacgggacgtacccgaaggaccgaaaggaaacggacggaaggtcctacggtaaccttatttaccgtagttacctaaacgtttcgtttaaccaacgtaacctaagttaccgtaaaggtttacgggtttaaacctttagttacggtttaccgtttaacgggaaaccgttaacggggtaaacccttaagggttaccccgttaacccggttaccgttaacgggttacccgaaccggacccccgtaaacgggacccctaaaccccctacgttaccggttacctaacccgttcccgtttaacccccg

SEQ ID NO: 322512 - DNA, 623 bp, Homo sapiens
  misc_feature: GZ8MTXP01ER0YQ.51.6.A06.1.454.CMB.2.raw
  modified_base (462)..(462): a, c, t, g, unknown or other
  misc_feature (462)..(462): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagcttgggtttttcctcgttgcttcttttaagaggtgtccagtgtcaggtgcagctggtgcagtcgtgggggaggcgtggtccagcctgggagtccctgagactctcctgtgaacgctctggattcagcttcagtacgtatggtttgcgtcgttgggccgccgaggcctccgaggacgaaaggggctgcgtaggtggggtcgcatctaactatacaagtataggaaaaagggaaacaactaaaataaactactacgacgaacgacgtacggaggaacggactactacactactacacgaagaacaacaaaccaaccaaanaacctaacttaactttagtactaacgaactaaacgtacgaaacctacctagtaacgtacgtaggaacgtaacgtacgttcgttacgttacttaagtttaggttcggacggttagggaaggtagggtaacgtaacgtacgttaacgtaacgttaacgtaacg

SEQ ID NO: 322513 - DNA, 539 bp, Homo sapiens
  misc_feature: GZ8MTXP01AERYD.51.6.A06.1.454.CMB.2.raw
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (406)..(406): a, c, t, g, unknown or other
  misc_feature (406)..(406): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattcgccaaacccacttattcttattcggtaccagcagagccagccaggccctgtgttgtgatatataaagacactgagaggcttcgaggactcccgtgagcgattctcgtcgctcacctcgaggaaccaagtcggcacgnttcgacntcagtgagtcgagcaagagacggagtctagtacttacttntagtactagtcttagacactatcgtaggttagttacttagtgtacgtaccgtaggtaacggaacgttaggtcccgacgtacgtacggcgccgacgaaccgaccctaaccactcgttacctcgttcgttccccg

SEQ ID NO: 322514 - DNA, 574 bp, Homo sapiens
  misc_feature: GZ8MTXP01BCPM9.51.6.A06.1.454.CMB.2.raw
  modified_base (284)..(284): a, c, t, g, unknown or other
  misc_feature (284)..(284): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaacccatattcttattggtaccagcagagcaggccagccctgtgttgtgatatanaaagcactgagagccttgagggactccctgagcgtattcctctggcctccacctacgagggtaacaaagtgggtacactattcgacctatcgagtggagtccgaggcaagaagacggaggctagacttatttcctggtactaattcttacagacatcgagtgttacttagtcgtcgttaacggaacgttcggggaaccttaagggtacctacccggttaccgttacggttaccgaacgaccccgaaccgggtaccccaaacccccttacgtaaccggttccgtaaccccg

SEQ ID NO: 322515 - DNA, 789 bp, Homo sapiens
  misc_feature: GZ8MTXP01EL8PN.51.6.A06.1.454.CMB.2.raw
  modified_base (311)..(311): a, c, t, g, unknown or other
  misc_feature (311)..(311): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtggggacgtccctgagactctccgtgtgaacgcctctggattcagtcttcagttacgtagttggtttgcgtcgtcggggtcccnccgaggcctccgaggcgaaggggctgcgagggtgggtcgctaatctaatagtcaagtagtacggaaaaaaggtaacgtaactaaaattaaaacgtacccgtaacggaccgtaacgggtaaccgttaccccgggtaggggaaaccgggggtccctaactttacccgaaacccgtaacgtttacccctaacccgaaagggtaaacccgaaaccgtaaaacccttaacccccggaaaaaagtaaaccccttaaaccggtttaaactttttaaactaccgttaacggtaaaaccaaaacgttacccggaaaacccctaaccccgttaagggtaaaccggttaacccgtttaggggaacggtaaacccgtaaccgggttcttaacggtttaccttaaagttttacggttacggggttcgaacggggtaaaggggtaggggtaaattaccggttaccgggaattcccggaaaacgtaacccggg

SEQ ID NO: 322516 - DNA, 597 bp, Homo sapiens
  misc_feature: GZ8MTXP01C91Q8.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctggggaggtccctgagactctcctgtgaagcctctggattcagcttcagtacgtattgggtttgcgtcgtggggtcccgccgaggcctcccgagggaccaaagggggctggcaggtgggtgcatctatatcatatagaaaaggaagcaaataaactaactacgacaagactccgtagaacgggccaattccaacctatacctaccaagaacgaaccaaactaccccaaaagaaaccaacgttaaccttttaatacctaagaacaaaacgtcgaaacctaacccgtagaacgtactaggaacggaaccaacgggttcttagttacttaagttattggttgacggaaggtagggaagagtacgatcaacgaacg

SEQ ID NO: 322517 - DNA, 777 bp, Homo sapiens
  misc_feature: GZ8MTXP01D1R9U.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggagtccctgagactctctgtgagcctctggattcagcttcagttacgtattggtttgcgtcgtgggtcccgccgaggcctcccgaagggtccgaaagggggtacctgggccgtagggttgggggtcggctaattccgtaactacttacgaagttaagtagggaaaaaaacgggaaacgtaaccgaaaatttaaaaacgttaccgttaaaccggaccgtaaacgggtaacccgttaccccgggtaggggtaaaccgggggtacccggtaacgtttacccgaaaccccgtaacttaccccttacccgaaacggaaaccggaaaccaaaaccttaacccccgaaaacgtaaaaccctaaaccgttaaacctttttaacgtaccttaacggaaacctaaaacgttacggaaaccctaaccccgttaggtaaacgtaacgtttacgggaaaggtaacccgaacgggttcttacggttaccttaagttttaagtttggttcggaccgggtaagggtacggggaagtacgttaccggattaaccaacgtaaccgg

SEQ ID NO: 322518 - DNA, 583 bp, Homo sapiens
  misc_feature: GZ8MTXP01APFKP.51.6.A06.1.454.CMB.2.raw
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
  modified_base (481)..(481): a, c, t, g, unknown or other
  misc_feature (481)..(481): n is a, c, g, or t
  modified_base (540)..(540): a, c, t, g, unknown or other
  misc_feature (540)..(540): n is a, c, g, or t
  modified_base (545)..(545): a, c, t, g, unknown or other
  misc_feature (545)..(545): n is a, c, g, or t
  modified_base (554)..(554): a, c, t, g, unknown or other
  misc_feature (554)..(554): n is a, c, g, or t
  modified_base (568)..(568): a, c, t, g, unknown or other
  misc_feature (568)..(568): n is a, c, g, or t
  modified_base (582)..(582): a, c, t, g, unknown or other
  misc_feature (582)..(582): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctctgtgaagcctntggattcagcttcagtacgtatggtttncgctgggtcccncgaggctcgaggcgaagggctgcgaggtgggtgcatctatatcagtatacggaaaaggaagcaaaataaactactacgacaaggtaaccttccgaggaaacggggccctaattacccgaacctattacccgaccgaaggaacgaacctaaactaccccaaagaaacccctacgttaaacttttacnccttagaaccctaaatacgaaacctaacccgtgaaacgtactaggacggaacacggttntgttntattgttgngacgaaggaggaanagtcgatcgaacgng

SEQ ID NO: 322519 - DNA, 676 bp, Homo sapiens
  misc_feature: GZ8MTXP01C3MVH.51.6.A06.1.454.CMB.2.raw
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcgagtcgtgggggagcgtggtccaggcctggggagtcctgagactctctgtgagctntgatcagctcagtacgtatgggttgcgtcgtacgggtcccncgacgggtccctacccggaagggacgaaacgggggtcctgggacgaggggttggggtacgcagttcttaatatcaatagtaggaaaaaagggaacaactaaaataaacttacgaacgctaacgtacgtccggtaggaacggcctaattaccactacgtactaccgaagaacgtaaccaaacaccccaaaagtaaaccaacgttacctttaagaccgttaaagaaacctaaacgtaacgaaaccctaccgtagtaaacgtacgtacgggaaacggtaaccgtacggttacgttagttacgtttaaagtttaggttgggttacgggaaacgggtaaggggtaaacgggtaacgtaacgtacggttaacgtaaccgaaccgcg

SEQ ID NO: 322520 - DNA, 627 bp, Homo sapiens
  misc_feature: GZ8MTXP01EXXE3.51.6.A06.1.454.CMB.2.raw
  modified_base (583)..(583): a, c, t, g, unknown or other
  misc_feature (583)..(583): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagcccaccctggtgtccgtgtcccccaggacaggacggccaggatcacctgctctggagatgctattcgacccaaaccctattatttcttagttcggtaaccagcagaacgccaggccacggcccctgtgttgttgataataataaagacacgtagagacggtcctttacgagggtactcccgtagacgtcgtacttcgtcgtccggcctaccgaccgtcgaacgggaaacaagttcggtacaacgtacttacgaacctagtcgtaggtcggacgtcgagggacaaggaagacggaggtctagtacttattctagtactaagttcttacgacgtactagtacgtaggttaggttaactttagtcgttacgtacggtaacgtaacgggtaaccttaaacgggtccgttaccgtacgtacggttaccncgacccgaacggcccaacccgtctcgactaaccgttcgtccccg

SEQ ID NO: 322521 - DNA, 507 bp, Homo sapiens
  misc_feature: GZ8MTXP01D5NX8.51.6.A06.1.454.CMB.2.raw
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (454)..(454): a, c, t, g, unknown or other
  misc_feature (454)..(454): n is a, c, g, or t
  modified_base (489)..(489): a, c, t, g, unknown or other
  misc_feature (489)..(489): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgtgttgatatataaagacactgagaggccttcgagggactccctgagcgattctcgtcggctcacctcagggaacaatggcacattgacctatcgagtgatccgagcaagaagacgaggctgactattctagtcaattcttcagacatcagtgtactntntctcgactggaacttagggtcncgtcgtagttcacgacccaaggacccaaccctacncgttactcttcgttcccg

SEQ ID NO: 322522 - DNA, 557 bp, Homo sapiens
  misc_feature: GZ8MTXP01BJ9UG.51.6.A06.1.454.CMB.2.raw
  modified_base (301)..(301): a, c, t, g, unknown or other
  misc_feature (301)..(301): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttcctcgttagctcttttaagaggtgtccagtgtcaggtgcagctggtgcagtcgtgggggagcgtggtccagcctgggaggtccctgagactctctgtgagctctggattcagcttcagttacgtattgggtttgcgtcgtggggtcccncgaggcctccgaggcaaggggctggcaggtgggtgcagtctatatcatancgaaaagaacnaaataaatactacgatacgactccgtagaacggcatcaccntctacagacacaactccaaanacactacttactcgtacgaactaaacgtcgaaaccaccgtagaacgtacgtaggacgaaccgtcggttcttcgttactaagttagttggacgacggaagggtagggaactacgtacgacgtaacgaacgaacg

SEQ ID NO: 322523 - DNA, 719 bp, Homo sapiens
  misc_feature: GZ8MTXP01AGXRR.51.6.A06.1.454.CMB.2.raw
  modified_base (583)..(583): a, c, t, g, unknown or other
  misc_feature (583)..(583): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcaggtcgtgggggagcgtggtccaggccgtgggacgtccctgagactctctgtgacgcctctggattcagcttgagttacgtagttggtttcgcgtcgtcgggtcccgccgaggcctacccgaggacgaagggggactggcgtagggtgggtgactagtcctaatagtacagttaagaggaaaaaagggaacaacctaaaaatttaaaacgtaaaccgttaccgacgtaaacggtacccgttaccccgggttaagggaaaccgggggtacccgtaacgtttaccccgaacccgtaacttaccccgtacccgaaaggtaaaccgaaacccgaaaacccgtaacccccaaaacgtaaacccctaaaccgttaacctttttaaaccnccttaacgaactaaaactaccggtaaaccctaaccccgtagtacgtaacgttacggaacggaacctacggttccttaggttacttagttagttggttgacggaaggaggggtaacacgtacgactaacgaacgtcg

SEQ ID NO: 322524 - DNA, 606 bp, Homo sapiens
  misc_feature: GZ8MTXP01AS02C.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgctattcgacccaaacccattattcttattcggtaccagcagaagccaggccaggcccctgtgttgttgatataataaagacactgagaggccttacgaggggtactcccgtgagtcgtacttcgtctcggcctccaccgtcgaacgggaacaattcggtacaactattcgaacctatcgaagtcggagtacccgagggacaaggaaggacggaggctagacttatttcgtagttacaagttcttacaagactatcgaggttggttactttatcggttcgttacgggaactcgggaaccgttaggtccgttaccgtcgtaacggttccgaccgttacccgaacggacccctaaccccgtacgtacgttccctaacgtttccgtaacccc

SEQ ID NO: 322525 - DNA, 647 bp, Homo sapiens
  misc_feature: GZ8MTXP01AEZRM.51.6.A06.1.454.CMB.2.raw
  modified_base (508)..(508): a, c, t, g, unknown or other
  misc_feature (508)..(508): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccaggccgtggggacggtccctgagactctcctgtgaagcctctggattcagcttcagttacgtatggtttgcgtcgtcgggtcccgccgaggcctccgaggacgaagggggactggcgtagggtgggggtgactagttctaatactacgaataagtaggaaaaaagggaacgtaactaaaataaaataccgtacgacgaagtaccgttacccggagaaacggggcctattaccacctaatcctaccgagacgtaaccaaacgtacccaaagaaccacgttaactttanaccgtaacgaactaaagtcgaaaccctacccgtaggtaacgtaaccttagggaacgtaaccaacgggttcttacgttacgttagttacgttggttcggacggaagggtagggaactacgtacgactaaccgaacgaacg

SEQ ID NO: 322526 - DNA, 662 bp, Homo sapiens
  misc_feature: GZ8MTXP01BAVNP.51.6.A06.1.454.CMB.2.raw
  modified_base (230)..(230): a, c, t, g, unknown or other
  misc_feature (230)..(230): n is a, c, g, or t
  modified_base (450)..(450): a, c, t, g, unknown or other
  misc_feature (450)..(450): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccntattcttatggtaccagcagaagccaggccaggcccctgtgttgttgatatataaagacactgagaggccttacgagggactcccgtgagcgtattctctcggctccaccgtcgagggaaacaatggtacaactattcgaacctatacagttggacgtccgaaggcaaggaagacggaagggtcctgtaaccttagtttctagttaccaagttcctttanaacggaactacttacgtagttcgggttaaactttacgtcggttaccgttcggggaaaccgtcggggtaacccgttaaaggggtccccttaacccgggttacccgttaaggggttacccgaccgggttaacccccccgaaaacgggggtaccccccaaaaccccccggttacgttcccggttacccctaacccgtttccctttaaccccccgg

SEQ ID NO: 322527 - DNA, 624 bp, Homo sapiens
  misc_feature: GZ8MTXP01CNE2Z.51.6.A06.1.454.CMB.2.raw
  modified_base (331)..(331): a, c, t, g, unknown or other
  misc_feature (331)..(331): n is a, c, g, or t
tcagcgatcgtatacacgaccggtgctcgatttagatctactgacgagggggtgggtccaggaggcagaactctgggtgtctcaccatggcctggatccctctacttcctccccctcctcactctctgcacaggctctgaggcctcctatgtgctgacacagcccaccctcggtgtccgtcgtccccaggacagacggccaggatcacctgctctggagatgcattcgacccaaaccctacttattcttattcggtaaccagcaagacgccaggccacggccctgtgttgttgataatataaagacactgagaggccttgagggactcccngagcgtattctcgtcggcctaccacctagagggaaacaagtcggtacactattacgaccctatcgaaggttcggacgtacgaggacaaggaagtaacggaggctagacttagtttctagtacctaagttctttaaccgagtaacctattcgtaggttcggtttaaaccttgttcgttacgttaacgggaacgttaacgggaaccttaacgggttccaccggttaccgtaggttaccgacgttaccccaaacgaccccaacccctctcgttaccctaaccttcccgttaacccc

SEQ ID NO: 322528 - DNA, 662 bp, Homo sapiens
  misc_feature: GZ8MTXP01BWR3Y.51.6.A06.1.454.CMB.2.raw
  modified_base (256)..(256): a, c, t, g, unknown or other
  misc_feature (256)..(256): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctcctatgtgctgacacacgcccaccctcggtgtccgtcgtccccaggacaggacgccaggactcacctgctctgganatgcattcgacccaaaccctacttattcttaattcggtaccagacagaacgccacggccacggcccctgtgttgtgatataataaagaccactagagacgtccttaacgagggtctcccgtagacgcgtattctcgtcgcctccacctcgaacgggacctaaagttcggtactaacgtacttacgaaccctaagtaccgtaaggttcgggggaaacgttaccccggaaagggacccgaaagggaaacggtaaccggaagggtaccttacggtaaacctttaagttttcctaggttaacctaaacgtttcctttaaccaggtaaacctagttaccgttaggttacggttaacctttagttcggtttaccgttacgggaacgttaacgggggaaaccctaaaccgggg

SEQ ID NO: 322529 - DNA, 692 bp, Homo sapiens
  misc_feature: GZ8MTXP01BH1PV.51.6.A06.1.454.CMB.2.raw
  modified_base (315)..(315): a, c, t, g, unknown or other
  misc_feature (315)..(315): n is a, c, g, or t
  modified_base (667)..(667): a, c, t, g, unknown or other
  misc_feature (667)..(667): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcgagtcgtgggggaggcgtggtccaggccgtgggacggtccctgacgtactctccgtgtgaacgcctctggtatcagcttcgagttacgtagttggttcgcgtcgtcggggtcccncgacggcctccgagggcgaacgggctggctaggggtgggtgactagtctaatactacgaagtagtaggaaaaaagggaacaactaaaagtaaacttacgaccgacgtaacggtaccgtaccggtagggaaacgggtccctaagttaccaacctactacccgtaccgaagaacgaaccaaacgtaaccccgaaaagtaaaccctaacgttaacttttaaactccgtaacgtaaactaaaacttccggaaaccctacccgttagaaacgttacgtacggaacggaactcgggttcttacggttacttaaagtttaggttgggttcggaacggtaaggggtacggaagttaacgnggttaacttaaccggaactaaccgg

SEQ ID NO: 322530 - DNA, 681 bp, Homo sapiens
  misc_feature: GZ8MTXP01CW8WW.51.6.A06.1.454.CMB.2.raw
  modified_base (372)..(372): a, c, t, g, unknown or other
  misc_feature (372)..(372): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgaggtcgtgggggagcgtggtccagccgtgggagtcctgagactctctgtgagcctctggattcagcttcagttacgtagttgggtttgccggtcgtcgggtcccgccgaggcctccgaggcaaaggggctggcgaggtggggtgctatctatatcatatggaaaaggaancaaataaatacctacgacaacgacgtccgagaacgggcctattccaacctatactaccaagaacgaacaaactaccccgaaaagtaacccaaacgttaaccttttaactaccttaacggaaacctaaaacgttaaccggaaacccctaaccccgttagggtaaaccgttacgttaacgggaaaccgggtaaccgtaaaccgggttctttacggttacctttaaagtttacgtttagggttacggttacgggaaaggggtaacgggggtaagtaacggttacgggaactttaacccgaaccgtaaccggg

SEQ ID NO: 322531 - DNA, 708 bp, Homo sapiens
  misc_feature: GZ8MTXP01CZ7SH.51.6.A06.1.454.CMB.2.raw
  modified_base (302)..(302): a, c, t, g, unknown or other
  misc_feature (302)..(302): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgttgggttttcctcgttgctcttttaagaggtgtccagtgtcaggtgcagctggtgcagtcgtgggggagcgtggtccaggcctgggagtccctgagactctcctgtgagcctctggattcagcttcagttacgtatggtttgcgtcgtcgggtcccncgacggcctccgaggacgaagggggctggcgtagggtgggggtgactatctaactactacaagtaagtacggaaaaagggaaataactaaaattaaaacgtaaccgtaacgacaacgtacgtaccggtaggaaaccggggacctaacttaccgaaccctatacccgtaccgaaggaaacgaaccctaaaacgtaccccaaaagtaaacctaaaccgttaacccttttaagtaccttaacggaaacctaaaacttaccggaaaccctaacccgttaggaactaccgttagggaacggtaaaccgtacgggttaccttacggttacttaaagtttgtttagggttccgggttagggtaaggggaaagggttaacgggaatttacgggaacttaaccgaaccgaaccgg

SEQ ID NO: 322532 - DNA, 555 bp, Homo sapiens
  misc_feature: GZ8MTXP01EKHFH.51.6.A06.1.454.CMB.2.raw
  modified_base (298)..(298): a, c, t, g, unknown or other
  misc_feature (298)..(298): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggaggtccctgagactctcctgtgaagcctctggattcagcttcagtacgtatggttgcgctgggtcccnccaggctccgaggcaaggggctgcaggtgggtgcatctanatcatatgaaaagaancaaataaatactagcagactcgtagacggcgatcacatactcagacgacaaactcccaaagaaccactaactttaatctagactaaatcgaaaccaaccctgaacgtaccgttaggacggaacgacgggttcttacgttacgttaatttaagttggttgacgggtaaggaggggaatacgtacggaactccgaacgaacgg

SEQ ID NO: 322533 - DNA, 524 bp, Homo sapiens
  misc_feature: GZ8MTXP01BTTFX.51.6.A06.1.454.CMB.2.raw
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggaggtccctgagactctcctgtgaagcctctggattcagcttcagtacgtatggtttgcgctgggtccgccgaggctccgaggcgaaggggactggcaggtgggtgcatctatatcatangaaagaancaaataaatactacgcagactcgtagaacggcatcaccatcncananacatccaagacactactttanctagacaaagtcgaaccacctagagtacttaggacggtaacacggcttgttactagttacttggttcgcgtaaggagggaagtatcgactcaacgaacg

SEQ ID NO: 322534 - DNA, 725 bp, Homo sapiens
  misc_feature: GZ8MTXP01ETPB3.51.6.A06.1.454.CMB.2.raw
  modified_base (308)..(308): a, c, t, g, unknown or other
  misc_feature (308)..(308): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgcattcgacccaacccatattcttagttggtaccagcagagccaggccacggccctgtgttgttagatatataaacgacactgaagnggtccttcgagggactccgtgagtcgtacttcctcgtcggcctcccacccgttacgaagggaacctaaagtcgggtaccaacgtacgtttacggaccctaatccgtaagggtggacggtacccgaagggacccaaagggaaacgggtaacggacgggtaccttacggtaacctttaaacgttttccgttaacggggtaccttaaatttacccttacgaaacggtaacctaacgtttaccggtaaagggtttccggtttaacgtttaagttcggttaccggtttaaccggggaaccgtttaaacgggggaaccctttaaacgggtcccgtaaccccggtttaccgttacgggttaccccgtaacgggaccccaaccgggtcccccaaaaccccgttcttaaccgttaaccctaacccg

SEQ ID NO: 322535 - DNA, 563 bp, Homo sapiens
  misc_feature: GZ8MTXP01BR52U.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtcccccaggacagacggccaggatcacctgctctggagatgcattcgacccaaaccctacttattcttattcggtaccagcagaagccaggccagccctgtgttgtgatatataaagacactgagaggccttcgagggactcccgtgagcgtattctctcggcctaccacctcgacgggaacaagtggtacactattacgacctatcgagtggagtccgaggcagaagacgaggctgacttattctagtacaagttcttcagtacatcgtagttcggttacttgtgtcgttacggaacgtcgggaaccttagggtccttacgtccgtaggttcacggaccctaacggaccccaaccctcgtacgacctaacttccgtttccccg

SEQ ID NO: 322536 - DNA, 615 bp, Homo sapiens
  misc_feature: GZ8MTXP01ADQ6E.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctggtgtccgtgtccccaggacagacgccaggatcacctgctctggagatgcattcgacccaacccacttattcttattcggtaccagcagaacgccaggccacggccctgtcgttgtgatatataaagaccactgagacggtccttacgacgggtaactcccgtaggacgtccgtatttcgtccgttcggaccctacccgtacccgtacggaacgggtaacctaagtacggtaccaacgttacgttacgaaccctagtaccgtaggtacggggtacgtaaccgaggaacgaaacggaacgacggacggtaccgtagtactttactttcgtataactaacttcttacacgtaactagttacgttgttacgttaacttagtcgttacgtacggacgtaacggaacgtaaccgg

SEQ ID NO: 322537 - DNA, 592 bp, Homo sapiens
  misc_feature: GZ8MTXP01B5KQI.51.6.A06.1.454.CMB.2.raw
  modified_base (427)..(427): a, c, t, g, unknown or other
  misc_feature (427)..(427): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaaccctactattcttattggtaccagcagaagccaggccaggccctgtgttgtgatatataaagacactgagaggcttcgagggactccctgagcgtattctcgtcggctccacctcgaggaacaagtggtacacattcgacatcagtgagtccaggcagaagacgaggctgacttatttctagtactaagttcttanacgtactatcgaggttggttaaccttagttcggttaccgttacgggaaccgttaacggggaaccgttaaacgggtccttaacccggttaccgttaaggttaccgacggaccccgaaacgggacccctaaaccccgacttcgttacctaaccgttccgtttccccg

SEQ ID NO: 322538 - DNA, 700 bp, Homo sapiens
  misc_feature: GZ8MTXP01ELPO7.51.6.A06.1.454.CMB.2.raw
  modified_base (301)..(301): a, c, t, g, unknown or other
  misc_feature (301)..(301): n is a, c, g, or t
  modified_base (389)..(389): a, c, t, g, unknown or other
  misc_feature (389)..(389): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtgggggagcgtggtccagccgtgggacggtcctgagactctctgtgagcctctggattcagcttcagttacgtatggtttgcgtcgtgggtcccnccgaggcctacccgagggacaaagggggtactcgggcgtagggtgggggtacgactagtctaatatcgaagtaagtggaaaaaagganaactaaaataaacttaccgtaacggacaacgggtaccgttacccgggtaggaaacggggtccctaattacccaacctagttacccaccgaaagaacggaaacctaaaccgtacccgaaaagtaaacctaacccgttaactttttaactaccggttaacgaaacctaaaacgttccggaaaaccctaaccccgttggaaaccggtacgtttaacggggaacggtaaccgtaacgggttctacggtttaacctaagtttaacgttggacggttacggaagggagggtaatagtccgttatccgaacgtaacgg

SEQ ID NO: 322539 - DNA, 593 bp, Homo sapiens
  misc_feature: GZ8MTXP01AOHNG.51.6.A06.1.454.CMB.2.raw
  modified_base (300)..(300): a, c, t, g, unknown or other
  misc_feature (300)..(300): n is a, c, g, or t
  modified_base (447)..(447): a, c, t, g, unknown or other
  misc_feature (447)..(447): n is a, c, g, or t
  modified_base (466)..(466): a, c, t, g, unknown or other
  misc_feature (466)..(466): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctggggttttcctcgttgctcttttaagaggtgtccagtgtcaggtgcagctggtgcagtctgggggagcgtggtccaggcctggggaggtccctgagactctcctgtgaagcctctggattcagcttcagtacgtatggtttgcgcgtgggtcccnccaggctcgaggcaaggggctgcaggtgggtggcatctatatcatatagaaaacgagcaaataaacgtcaacgcaagacctccggtagaaacggggcccgtaattccaacccataccctaccaggaacgaaccaaactccccgaaanaaccaacgtacttttaacnctacgaacctaaaagtcgaaaccaccccgttgaacgtaccttaggaacggtaaccaacggttctaggttaccttaagttaattcggttgccggaaggaggggtaatacacggacttaacaacgaacg

SEQ ID NO: 322540 - DNA, 717 bp, Homo sapiens
  misc_feature: GZ8MTXP01B6L9M.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgaccaacccatattcttattggtaccagcagaagccaggccacggccctgtgttgtagataataataaagctactgagacggccttcgagggactcccgtgacgcgtattctcgtcggtcctccaccgtacaaggggtaaactaacgtcggtaccaacgtagttacggaacctagtcgaacgggtagggtaacgtacccgaagggaccaaaggaacggaaccggagggtctacggtaacttaactttccgtagttacctaaagtttctttaaccggaataaccctaagtacccgtaaggttacggtttaaactttacgttacggtttaccgttaaccggggaacgttaaccgggggtaaacccgttaacggggttacccgttaacccgggttacccgttaacgggttacccgaccggttaacccccgtaaaccggggtacccccaaacccccgtacgttacccggttacctaacccttcccgtttaacccccgg

SEQ ID NO: 322541 - DNA, 729 bp, Homo sapiens
  misc_feature: GZ8MTXP01C95CL.51.6.A06.1.454.CMB.2.raw
  modified_base (328)..(328): a, c, t, g, unknown or other
  misc_feature (328)..(328): n is a, c, g, or t
  modified_base (423)..(423): a, c, t, g, unknown or other
  misc_feature (423)..(423): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgaggtcggtgggggaggcgtggtccagccgtggggacgtccctgacgactctcctggtagaacgccttcgtggtacttcagtcttacgaggttacgttagttgggtttcgccgtcgtcggggtcccnccgaggcctaccgaggacaaagggggctgggcgaggggttgggggtcgacctagttaccttaatacgtacaagttagtaagggaaaaaagggaanaacctaaaaagttaaaactaaccgtaacggacctaaacgggtacccgtacccgggtaggaaacggggtccctaattacccaacctactaccgtaccgaagaacgaaaccaaactacccgaaaacgtaaccctaacgttaaacttttacgaccgttacgaaacctaaaactccgtaaaccctacccgtagaacgtaacgttaggaaacggtaacgtaccggttacgttcggttaactttaaggttagtttacggttgggaccgggtaaagggagggaacgtagtacggataaccgaaccgtaaccgg

SEQ ID NO: 322542 - DNA, 655 bp, Homo sapiens
  misc_feature: GZ8MTXP01A78S0.51.6.A06.1.454.CMB.2.raw
  modified_base (509)..(509): a, c, t, g, unknown or other
  misc_feature (509)..(509): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggagcgtggtccagccgtggggacgtccctgagactctctgtgaacgcctctggacttcagcttcgagttacgtagttggtttcgcggtcgttcgggtcccgccgagggcctccgagggacaagggggtactggcgagggtgggtggctatctaatatcaatagtaggaaaaaggaacgaactaaaataaaacgtacctacgactaacggaccttccgggtaggaaacggggtccctaattaccaacctatcctaccgaagacgaacctaaactacccaaagaacctactaacttttaanacctacgaactaaacgtacgaaacctacccgtagtaacgtacgttacggaacggtaaccgtacggttacttacgttacttaagtttagttaggttcgggacggtaagggagggtaacgtacgtaccgacgtaacccgaacgtaacg

SEQ ID NO: 322543 - DNA, 778 bp, Homo sapiens
  misc_feature: GZ8MTXP01DVIY4.51.6.A06.1.454.CMB.2.raw
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacacgccaccctcggtgtccgtgtccccaggacagacggccaggatcacctgctcgtggagatgcattcgacccaaccctacttattcttagttggtaccagcagaacgccaggccacgccctgtgttgtgatataataaagacacgtagagacggtcctttacgagggtactcccgtagagtcgtactttccctcgtcggacctcccgaacccgttaacggaacggggaacctaaaacgttcgggtaaccctaaacgtaacgtttaccggaaacctaagttaccgaaggttacgggaacgtacccgaagggaccgaaaaggaaacggaaccggagggtaccttacggtaacctttaaagtttccgttacggggttaactaaactttacctttacgaacgtaactaacgttccgtaaaggtttcggggttaaacttttacggttcggtttccgggtttaaaccgggtaaacggttaccgggggtaaacccgttaaacgggttacccggtaacccggtttacccggttaacgggttaccccgtaacccgggtaacccccgtaaaccggggtaaccccccaacccccgttaacgtttcccggttaaccccgtttaaccccg

SEQ ID NO: 322544 - DNA, 597 bp, Homo sapiens
  misc_feature: GZ8MTXP01DYPIK.51.6.A06.1.454.CMB.2.raw
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (541)..(541): a, c, t, g, unknown or other
  misc_feature (541)..(541): n is a, c, g, or t
  modified_base (577)..(577): a, c, t, g, unknown or other
  misc_feature (577)..(577): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccaggccgtgggacggtccctgagactctcctgtgaagcctntggatcagctnagtacgtatggttgcgcgtgggtccnccgaggctccgaggcgaagggctgcgaggtgggtgcatctatatnaatatagaaaagaagcaaataaactactacgacaacggtactccggtagaacggccgtaattaccacctaatacctaccgaagaacgaacaaactaacccaaagaaacctaactaaccgttttaatacctagaaactaaactacgaaacctaccctagaacgtacttacggagggtaacccagggcttacgttnttaaagttgttaggttggacgaagggaacgggtaanacggtgaactccgaagaacg

SEQ ID NO: 322545 - DNA, 669 bp, Homo sapiens
  misc_feature: GZ8MTXP01EIKEW.51.6.A06.1.454.CMB.2.raw
  modified_base (260)..(260): a, c, t, g, unknown or other
  misc_feature (260)..(260): n is a, c, g, or t
  modified_base (391)..(391): a, c, t, g, unknown or other
  misc_feature (391)..(391): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccagccgtgggacggtccctgagactctcctgtgaacnccgggtctggatcagcttcagttacgtattggttgcgtcgtcgggtcccgccgaggcctccgaaggcgaaaggggctggcgtagggtgggtggctaagttctaatagtcaagtagtaggaaaaagggaaanaactaaaataaaacgtacgtaaccgacgaacggtaccgttaccggtaggaacgggtcctaactaccaacctacgtaccctaccgaagaacgaaaccaaacctaacccgaaaacgaacctaacgttaactttaactacctacgaaactaaacgtaccgaaaccctaaccgtagtaacgtacgtacggaacggaacgtacggttcttcgttacgttagttacgttggttacggacggtaagggaagggtaacgtacgtacgttactaaccgaacgtaacg

SEQ ID NO: 322546 - DNA, 555 bp, Homo sapiens
  misc_feature: GZ8MTXP01EOB03.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggatcacctgctctggagatgcattgccaacccatattcttatggtaccagcagaagccaggccaggccctgtgttgtgatatataaagacactgagaggtcttcgagggactccctgagcgattctctcggctaccactcagggaacaatggtacacattcgaccatcagtgagtccaggcaagaagacgaggtctgacttattctagtcaaatcttacaagacatctagtggtattattgttcgttacggtaacgtaacgggtaaccgttaacggtaccgttaccgtaccgtacgttacgttacgttaccgaaccggacccgaaccccacctacgttctaaccgttccttccccg

SEQ ID NO: 322547 - DNA, 738 bp, Homo sapiens
  misc_feature: GZ8MTXP01ENICK.51.6.A06.1.454.CMB.2.raw
  modified_base (322)..(322): a, c, t, g, unknown or other
  misc_feature (322)..(322): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggaggcgtggtccagccgtgggacgtccctgacgactctcctgtgaacgcctctggtacttcagtcttacgaggttacgtagttgggtttcgccggtcgttcggggtccccnccgaagggtccctaccgaagggtacgaaacgggggtactgggcgtagggtgggtacgctaagttctaatactacaagtaagtacggaaaaaaagggaataactaaaattaaaacgtacctaacggacgtaacggaccgttacccgggtaggaaaccggggtccctaactttacccgaacctaacttacccgtaaaccgaagtaaaccgaaacctaaaccgttaaccccaaaagtaaaccctaacgtttaacttttaacgtacctaacgaaacctaaacgtacggaaaccctacccgtaggaaaccgttacgttacggaaacggaacctacgggttacttacgttaccgttaaatttaacgttggttcggaacggtaaggggaaggtaagtaactcggaacttaaccgaacgtaacg

SEQ ID NO: 322548 - DNA, 575 bp, Homo sapiens
  misc_feature: GZ8MTXP01D1ABE.51.6.A06.1.454.CMB.2.raw
  modified_base (442)..(442): a, c, t, g, unknown or other
  misc_feature (442)..(442): n is a, c, g, or t
  modified_base (460)..(460): a, c, t, g, unknown or other
  misc_feature (460)..(460): n is a, c, g, or t
  modified_base (557)..(557): a, c, t, g, unknown or other
  misc_feature (557)..(557): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagcttgggtttttcctcgttgctcttttaagaggtgtccagtgtcaggtgcagctggtgcagtcgtgggggaggcgtggtccagcctgggagtccctgagactctctgtgaagctctggattcagcttcagttacgtatggtttgcgcgtgggtcccgccaggctccgaggacgaagggactgcgaggtggggtacgcatctatatacaatataggaaaacgaagaacaaaataaataactacgacagactccggtaggaaacgggccatcaccattcaccagacacaaactacccaaanaacactaactttagctanaacaaactcgaaacctacccgtagaacgtactaggaacggaactaacgggcttaggttacttaagttaagttgggttgacggaaggaggggaactanaccggataacaaccgaag

SEQ ID NO: 322549 - DNA, 697 bp, Homo sapiens
  misc_feature: GZ8MTXP01CS6WL.51.6.A06.1.454.CMB.2.raw
  modified_base (252)..(252): a, c, t, g, unknown or other
  misc_feature (252)..(252): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctctatgtgctgacacagcccacctggtcgtccgtcgtccccaggacagacggccaggatcacctgctctgganatgcattcgacccaaccacttattcttagtcggtaccagcagaagccaggcaggcccctgtgttgtgatatataaagaccactgagtacggccttacgaagggtaactcccgtagaacgtcgtacttctcgtcgggcccttaccaccgttacgaacggggaacctaaagttcgggttaccaactaagtttacggaacccctaagttacccgaagggttacgggggtaaacggttaccccggaaagggacccgaaaagggaaaacgggaccgggtaacggggtacccttaggttaaacctttaaattttcccgttaggttaaaccgttaaactttccgttttaccgaaagttaaacctagtttaaccggttaggttacggtttaacctttaaagtttcggttaccgtttacgggaaacgtttaacggggaacccgtttaaaccggg

SEQ ID NO: 322550 - DNA, 845 bp, Homo sapiens
  misc_feature: GZ8MTXP01CUFSO.51.6.A06.1.454.CMB.2.raw
  modified_base (259)..(259): a, c, t, g, unknown or other
  misc_feature (259)..(259): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggtttttcctcgttgcttcttttaagaggtgtccagtgtcaggtgcagctggtgcagtcgtgggggagcgtggtccagccgtgggacgtcctgagactctctgtgacgcctntggattcagcttcagtacgtatggtttgcgcgtggtcccgcaggctccgaggcaaggggctgcgaggtgggtcgactattcctaatacgtacaagttaagtaggaaaaaaaacgggaagtaacctaaaaaattaaaaacgtaccgttaaaccgggacctaaacggggtaaaccccgttacccgggttaaacggggtaaacgggggtaccccggttaaaacttttaccccgaaaccccgttaaacgttaccccgttaaacccccgtaaaggtaaaacccgggaaaacccctaaaaaccctttaacccccccgaaaaaaagggttaaaacccccttaaaccggtttaaaaccctttttttaaaccgtaacccgtttaaacgggtaaacccttaaaaaacccgtttaccggaaaaccccctttaaaacccccgggtaggtaaaaccggtacccgtttaaagggaaccgggtaaacccgtaaccggggttacgtttacggttaccgtttaaacgtttaggtttaacgggttcgggaacgggttaagggagggggtaatacggtacggttacttaacccgaacgtaaccgg

SEQ ID NO: 322551 - DNA, 495 bp, Homo sapiens
  misc_feature: GZ8MTXP01C53A1.51.6.A06.1.454.CMB.2.raw
  modified_base (349)..(349): a, c, t, g, unknown or other
  misc_feature (349)..(349): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaacccactattctattggtaccagcagaagccaggccaggcccctgtgtgttgatatataaagaccactgagaggccttcagggntcccctgagcgattctctggctccacctcagggacaatggtcacattgaccatcagtggggagtccaggcagaagcgagctgactattctgtcaattcttcagacnttcngttggtaacttatgtcttggactgggaacctaacgg

SEQ ID NO: 322552 - DNA, 523 bp, Homo sapiens
  misc_feature: GZ8MTXP01ASWPX.51.6.A06.1.454.CMB.2.raw
  modified_base (285)..(285): a, c, t, g, unknown or other
  misc_feature (285)..(285): n is a, c, g, or t
  modified_base (368)..(368): a, c, t, g, unknown or other
  misc_feature (368)..(368): n is a, c, g, or t
  modified_base (400)..(400): a, c, t, g, unknown or other
  misc_feature (400)..(400): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggtttncgctgggtccgccaggctccaggcaagggactgcagtgggtgcatctatatcatatgaaaaggaagcaaataaactactacgnagactcgtagaaggccgatcaccatctcaganacaatcccaaagaacacacttttaanctanacaaatacgaaccacctgaacgtacttggacggaacacggctgttacttattattggcgacggaaggagggaagtaacgtcgatcgaacgaag

SEQ ID NO: 322553 - DNA, 563 bp, Homo sapiens
  misc_feature: GZ8MTXP01B90NC.51.6.A06.1.454.CMB.2.raw
  modified_base (318)..(318): a, c, t, g, unknown or other
  misc_feature (318)..(318): n is a, c, g, or t
  modified_base (358)..(358): a, c, t, g, unknown or other
  misc_feature (358)..(358): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcatttgaccaaaccctattattcttattcggtaccagcagaagccaggccaggccctgtgttgtgatatataaagacactgagagcttcgaggactcccngagcattctcgtcgctccactcgagggaacaagtgtacanattcgacctagtcaggtgtacgccgaaggacagaaacggacgaggctagacttagttctgtcaagttcttcaagacagtcaaggttggtaccttagtcgtacgttacggaacgttaacgggaacaagggtccaccgtccgtaaggttccgacgacccgaacggtaccccaacccctacgtcgttacctaaccgttccgttccccg

SEQ ID NO: 322554 - DNA, 542 bp, Homo sapiens
  misc_feature: GZ8MTXP01ANCHI.51.6.A06.1.454.CMB.2.raw
  modified_base (410)..(410): a, c, t, g, unknown or other
  misc_feature (410)..(410): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaaacccatattcttattggtaccagcagagccaggccaggcccctgtgttgtgatatataaagacactgagaggccttacgagggactcccgtgagcgattctctcggcctcacctcgaggaacaagtggtcactattcgactatcaagtggagtccaggcagaagacgagctgacttattcngtacaatcttacagtacatcgagtggttacttagtcgttcgttacggaacgtcgggaaccgttaggtccaccgtccgtaaggttccgacgcccaacggcccaacccgtactcgttcctaaccgttcgtcccg

SEQ ID NO: 322555 - DNA, 551 bp, Homo sapiens
  misc_feature: GZ8MTXP01CDVR4.51.6.A06.1.454.CMB.2.raw
  modified_base (362)..(362): a, c, t, g, unknown or other
  misc_feature (362)..(362): n is a, c, g, or t
  modified_base (407)..(407): a, c, t, g, unknown or other
  misc_feature (407)..(407): n is a, c, g, or t
  modified_base (436)..(436): a, c, t, g, unknown or other
  misc_feature (436)..(436): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtggggagtccctgagactctcctgtgaagcctcgtggattcagcttcagtacgtatggtttgcgcgtgggtccgccgaggcctccgaggcaaggggctggcaggtgggtgcagtctatatcaatatgaaaaggaancaaataaatacctagcagactccggagaacggcatcacatctcanagaacaactcccaaagaacactactttanctagacaaatcgaactaccctgaacgtacttaggacggtaacacgggttcttagttcttaagtttattggttgacggtaaggagggaagtaagtaccggatccgaacgtaaccgg

SEQ ID NO: 322556 - DNA, 662 bp, Homo sapiens
  misc_feature: GZ8MTXP01CCCVI.51.6.A06.1.454.CMB.2.raw
  modified_base (279)..(279): a, c, t, g, unknown or other
  misc_feature (279)..(279): n is a, c, g, or t
  modified_base (309)..(309): a, c, t, g, unknown or other
  misc_feature (309)..(309): n is a, c, g, or t
  modified_base (646)..(646): a, c, t, g, unknown or other
  misc_feature (646)..(646): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggtttttcctcgttgcttcttttaagaggtgtccagtgtcaggtgcagctggtgcaggtcgtgggggaggcgtggtccaggccgtgggacggtccctgacgactctcctgtgaacgcctctggattcagcttnagttacgtatggtttgcgtcgtgggtcccncgaggcctccgaggcgaagggctggcgaggtggggtgcagtcttaagtatcaattaagtaggaaaaaagggaacgtaactaaaagttaaaactaccgtaacggacctaaacgggacccgttacccgggtaggaaacggggccctaactttaccaacccttatacccgtaccaaaggaacgaaaccaaacctaccccgaaaagtaaaccctaacttaacttttaacgtacctacgtaaacctaaaagtccgaaaacctccccgtagtaacgtaacgttcggaacggaactaacggttcttaggttacttagttattggttgacggtaagggaggaagntcggatcgaacgaacg

SEQ ID NO: 322557 - DNA, 603 bp, Homo sapiens
  misc_feature: GZ8MTXP01B6PPN.51.6.A06.1.454.CMB.2.raw
  modified_base (366)..(366): a, c, t, g, unknown or other
  misc_feature (366)..(366): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttggggttttcctcgttgctcttttaagaggtgtccagtgtcaggtgcagctggtgcaggtcgtgggggaggcgtggtccaggccgtgggagtccctgagactctctgtgaagcctctggattcagctcagtacgtatggtttgcgtcgtgggtcccgccgacggctccgaggacgaaggggactggcaggtgggtgcatctatatcatatagaaaaggaancaaataaatactacgacagactaccgtacgaaggcgactcacactactacacgagacaactaccaacgaacaactactttactactacgtacaaacttttttacgaacctaacccgtacgtaacgtacgttacggtaacgggaaccgaacgggttacgttacggttacgtttaactttagtttggttggttacgggtaagggaggggtaaggtacgtacggactaacgaacgaacgg

SEQ ID NO: 322558 - DNA, 699 bp, Homo sapiens
  misc_feature: GZ8MTXP01CQT3I.51.6.A06.1.454.CMB.2.raw
  modified_base (308)..(308): a, c, t, g, unknown or other
  misc_feature (308)..(308): n is a, c, g, or t
  modified_base (567)..(567): a, c, t, g, unknown or other
  misc_feature (567)..(567): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccaggccgtgggacgtccctgagactctcctgtgacgcctcgtggattcagcttacgagttacgtgtggtttgcgtcgtcgggtcccnccgaggcctaccgagggccgaaagggggtcctgggacgagggttgggggcgactattccgttaattaactacaagttaagtaggaaaaaaaaggggtaaacaacctaaaagttaaaactaccgtaaccggaccgtaaacgggtaacccgtaccgggtaacgggaaacggggtaccctaaacttaccgaaacctaaacttccctaacccgaaagaaccgaaaccaaactacccaaaagaaaccctacgttaacttttaanctaacgaactaaacgtcgaaacctacccgtagtaacgtacttaggacgaacgtacggcttacgttacttaaagtttgttcggttggacgggaaggaaggggtaataacgtacgagttaaccaacgtaaccgg

SEQ ID NO: 322559 - DNA, 554 bp, Homo sapiens
  misc_feature: GZ8MTXP01DCB3Y.51.6.A06.1.454.CMB.2.raw
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
  modified_base (392)..(392): a, c, t, g, unknown or other
  misc_feature (392)..(392): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggaggtccctgagactctcctgtgagcctctggattcagcttcagtacgtatggtttgcgctgggtccnccaggctccaggcgaagggctgcagtgggtgcatctatatcatatagaaaagggaancaaataaatactacgcagactcgtagaaggcatcactanctaccagacgacaactacccaaagaaccactaactttanactanactaaaatgaacaacccgtgaacgtaccgttagaagggaaccacgggttaccttggttacttaagtttaattgggttcgacggtaaggaggggtaagaacttcggaatcccaagaacg

SEQ ID NO: 322560 - DNA, 598 bp, Homo sapiens
  misc_feature: GZ8MTXP01DVWIY.51.6.A06.1.454.CMB.2.raw
  modified_base (172)..(172): a, c, t, g, unknown or other
  misc_feature (172)..(172): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtntccgtgtccccaggacagacggccaggatcacctgctctggagatgcattcgaccaaaccctacttattcttattcggtaccagcagaagccaggccaggcccctgtgttgtgatatataaagacactgagagcttgaggactcctgagcgtattctcgtcgcctccacctcgagggaacaagtggtcaacattcgaccatacgagtggagtccgaaggcagaagacgaggctgactattctagtacaagttcttcagtacacgtcaggttggttaacttgttacgtcgtttacgggaacggttaagggaacccgttaaaagggttcccaacccggttaccgttaacggggttcccaccggttaccccgaaaccgggacccctaaaccccctacgttacggttacctaaccccttcgtttcccccg

SEQ ID NO: 322561 - DNA, 691 bp, Homo sapiens
  misc_feature: GZ8MTXP01B7WA1.51.6.A06.1.454.CMB.2.raw
  modified_base (218)..(218): a, c, t, g, unknown or other
  misc_feature (218)..(218): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattgcccaacccactattcttattggtaccagcagaagccaggccaggcccctgtgttgttgatatataaagacactgagaggcctttcagggactccctgagcgattcctctggctcccactcgagggaacaagtcgggtacaactactttaggaccatccgagtcgggaacgtccaagggacccaaggaaacggacgaaggggcttacggtaactttactttccgttggttacctaaagtttccctttacgaaagtaacccgtacgttacgtaacggttacggtttaaaccctttaggtttacggttcccggtttaacggggtaaaccgtttcggggggtaaaaccccttaacgggggtttacccgaccccggttttaacccggttacgggttacccgaaccgggttacccccgaaaccgggacccccgtaaaccccgttaccgtttaacggttccccttaaccccg

SEQ ID NO: 322562 - DNA, 533 bp, Homo sapiens
  misc_feature: GZ8MTXP01A7NZ2.51.6.A06.1.454.CMB.2.raw
  modified_base (215)..(215): a, c, t, g, unknown or other
  misc_feature (215)..(215): n is a, c, g, or t
  modified_base (307)..(307): a, c, t, g, unknown or other
  misc_feature (307)..(307): n is a, c, g, or t
  modified_base (409)..(409): a, c, t, g, unknown or other
  misc_feature (409)..(409): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtcccccaggacagacggccaggatcacctgctctgganatgcattcgccaacccatattcttattggtaccagcagagccagccaggcccctgtgttgtgatatataaagacactgagaggcttcgaggntcccgtgagcgtatctctcggctcacctcgaggaacaatggcacattcgacatcagtgagtcaggcaagaagacggagctgactagttctgtacagttcttnaagacatcagttcggtaacttgtgttcgttcggaacgttgggaacccttaaggtcccaccgtaccgtaggttccgacgcccctaagggccccaacccgactcgttaccaaccttcgttaacccc

SEQ ID NO: 322563 - DNA, 570 bp, Homo sapiens
  misc_feature: GZ8MTXP01EHQ2U.51.6.A06.1.454.CMB.2.raw
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggaggcgtggtccagccgtgggaggtccctgagactctctgtgaagcctctggattcagcttcagtacgtatggtttgcgcgtgggtcccgccaggctccgaggcaaggggctggcaggtgggtgcatctatatcaatatgaaaagaagcaaataaatactacgcagactccgtagaggccgatcacatactacagacgacaactaccaaagaacactaactttatactacgaacaaagtcgaaacctacccgtagaacgtaaccgttaggaacggaactacgggttacttacggttacttaagtttaagttggttagcggtaagggagggaagtacgtaccggataaccgaacgaacgg

SEQ ID NO: 322564 - DNA, 553 bp, Homo sapiens
  misc_feature: GZ8MTXP01C8AIT.51.6.A06.1.454.CMB.2.raw
  modified_base (254)..(254): a, c, t, g, unknown or other
  misc_feature (254)..(254): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctcccctcctcactctctgcacaggctctgacggcctcctatgtgctgacacacgcccacctcggtgtccgtcgtccccaggacagacgccaggatcactgctctgganatgcattcgccaacccactattcttatgtaccagcagagccagccagcccctgtgtgttgatatataaagaccatgagagcctacgagggctccctgagcgtattctctcggctccacctcgaacgggactaaagtggtacactacgttcgaactagtaccgaggtagggggaacgttcccgaaggaccgaaggaaagaccgaggtactagtaactttagttcctgtaacaaattcttacagactattcgagttacggtaacttagtcgttacgtacggaacgtcgggaaccgtaacgg

SEQ ID NO: 322565 - DNA, 686 bp, Homo sapiens
  misc_feature: GZ8MTXP01EOSKC.51.6.A06.1.454.CMB.2.raw
  modified_base (216)..(216): a, c, t, g, unknown or other
  misc_feature (216)..(216): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacaggacggccaggatcacctgctctgganatgcgttagccaaccctacttattacttattcggtaccagcagaacgccgacggccgacggcccgtcgtgttgttgaatataataaagacacgtgagaggtccttacagggactccctggagtcgtattctcgtggtccctccactcgacggggacaaaagtcggtcaacgtattcgaccatacgaggtggaacgtcgaacggacgaggaaaggacggtaacggtcttagtaacctttatttaccgtggtaaacttaaaccgttcgtttaacccaagggtaaccctaagttacccggttaagggttcgtttaactttaacttcggggttaccttttaaaccggggacgttaaccgggggaaaccctaaaggttcccgtaaccccgttcgtacggttaccgacgcccccgaaacgggtaacccccaaaccctaacgtttcgacccaccgttccttcccgtttaaccccccc

SEQ ID NO: 322566 - DNA, 658 bp, Homo sapiens
  misc_feature: GZ8MTXP01DA3ZS.51.6.A06.1.454.CMB.2.raw
  modified_base (629)..(629): a, c, t, g, unknown or other
  misc_feature (629)..(629): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccaggccgtgggacggtccctgacgactctcctggtgaacgcctctggtattcagcttcagttacgtatggtttgcgtcgtgggtcccgccgaggtcctaccgagggacgaaagggggactggcgagggtgggtggcctagtcttaatatacgaattagtaggaaaaaggaaagaacctaaaattaaaacgtaacgtaaccgacaacggtaacgtccggtaagaacggggaccctaattaccaaacctacgtacctaccgaaggaacaaccaaactaccccaaaacgaaccctaacgttaactttaactcctagaactaaacgtacgaaaccctacccgtagtaactacgtagaacggtaacacggttctagttacttaagttagttggttcggacggtaaggaagggngtaacgtccgttaataacgaacgaaccgg

SEQ ID NO: 322567 - DNA, 604 bp, Homo sapiens
  misc_feature: GZ8MTXP01A5H7Q.51.6.A06.1.454.CMB.2.raw
  modified_base (371)..(371): a, c, t, g, unknown or other
  misc_feature (371)..(371): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcaggtcgtgggggaggcgtggtccagccgtgggaggtccctgagactctcctgtgagcctctggattcagcttcagtacgtatggtttgcgcgtcgggtcccgccgaggcctccgaggcgaaaggggctggcgagggtgggtggcagtctatatcatagtaggaaaaggaanaacaaataaactactacgactaacgacgtaccggtaggaacggggcctaacgttaccacctataccgtaccagaacgaacaactaacccaaagaaccactaactttatactacgaactaaagtaccaaaccggggtaccctagtaacgtacgttacggaacggtaacgacggttctgttactaagttagttcggttgaggaaggagggtaagactacggactaacaacgaacg

SEQ ID NO: 322568 - DNA, 713 bp, Homo sapiens
  misc_feature: GZ8MTXP01C3A6B.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctcccctcctcactctctgcacaggctctgaggcctctatgtgctgacacacgcccaccgtcggtcgtccgtcgtccccaggaccagacggccaggactccacctgctcgtggagatgcattcgacccaaaccctacttactttctttaagttggtaacccaagcaaggaaacgcccgaacggccccgacgggtccccctttggtttcgtttagtttagtaacttaattaagtaaaacgacctacgtggagacggtccttaacgagggtctcccgtgagcgtattctctacggcccttaccaccgtacgacgggtactaacgtcggtaccaactagttaccgaaccctaattaccgtaagggttacgggggtaacggttacccgaaacgggaccgaaagggaaacggaaccgggtaggtacccgttaggttaacctttacggtttaccttacggttaacctaaacttccgtttacaacggtaaactacttaccggttagttacgggtttaaacctttggttccgttacggttacgggttaaccgttcggggaacccgttaaaccgggg

SEQ ID NO: 322569 - DNA, 734 bp, Homo sapiens
  misc_feature: GZ8MTXP01CX23J.51.6.A06.1.454.CMB.2.raw
  modified_base (306)..(306): a, c, t, g, unknown or other
  misc_feature (306)..(306): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccaggccgtgggagtccctgacgactctcctgtgaagcctctggattcagcttcgagtacgtatggtttgccgtctcggggtcccnccgaggtcctccgaggacgaaagggggctggcgagggttgggtgctagtctaatatcaagtagtaggaaaaaaggtaacgaactaaaataaaatacctaacggacaaacggtaccgtcccgtaggaaacggggcctaacttaccaacctactaccgtacccaaagtaacgaaaccaaacgtaaccccaaaagtaaaccctaacgttaaccttttaaactacgttaacggaaacctaaaaacgtaccgtaaaaccctaaaccccgtaggtaaacggtaacccgttagggtaaaccgggaacctaaacccggggttctttacggttaaacccgttttaagtttaacgttttagggttacgggttaccgggtaaagggggtaaaggggaaccgtaagttaccgggaaacttaacccgaaccggtaacccgg

SEQ ID NO: 322570 - DNA, 718 bp, Homo sapiens
  misc_feature: GZ8MTXP01CNTGW.51.6.A06.1.454.CMB.2.raw
  modified_base (214)..(214): a, c, t, g, unknown or other
  misc_feature (214)..(214): n is a, c, g, or t
tcagcgatcgtatacacgaccggtgctcgatttagatctactgacagggggtgggtccaggaggcagaactctgggtgtctcaccatggcctggatccctctacttctccccctctcactctctgcacaggctctgaggcctcctatgtgctgacacagccaccctcggtgtccgtgtccccaggacagacggccaggatcacctgctctgganatgcattcgaccaaacccattattcttattcggtaccagcaagaacgcaggccaggccctgtgttgtagatatataaagacactgagaggccttcgaggtactcccgtgagtctatctcgtccgcctccacgtcgaacgggaactaaagtcggtactaactagttacgacctatcgtaagtggacgtaccgaagggacaaaggtaaacgggacggaacgggtactacgggtaaccttaagttttcctagttaaccaaacgttttcctaacgttaaacggaacttaaagttccgttaagggttaggttttaaacttacgtttacggttacccgtttaaccggggtaaacgttccggggggtaaacccttaaacggggttacccttaccccgggttaaccgtaacgggtttaccccgaccggttaacccccggtaaacccgggaaccccctaaaccccgttaacccgttaccggttaccgttaaccccgttaacttttccccccgg

SEQ ID NO: 322571 - DNA, 563 bp, Homo sapiens
  misc_feature: GZ8MTXP01BTSJD.51.6.A06.1.454.CMB.2.raw
  modified_base (507)..(507): a, c, t, g, unknown or other
  misc_feature (507)..(507): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggaggcgtggtccagccgtgggagtcctgagactctctgtgaacgcctctggattcagcttcagttacgtagttgggtttgcgtcgtcggggtcccgccgaggcctccgaggacaagggggactggcagggtgggtgctatcgtatatcaatatagaaaaaggaagcaaataaatactaacgcaacgactccgtagaacggcattcaccatctacaagacaacaactacccaaagaacactaactttatccagaacaaagtcgaaaccacctagacgtacgttgaaggaactacggnttcgttactagttagttggttgacggtaaggagggaatagtcgaactcaacgaacg

SEQ ID NO: 322572 - DNA, 670 bp, Homo sapiens
  misc_feature: GZ8MTXP01AMS8G.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgcttcttttaagaggtgtccagtgtcaggtgcagctggtgcagtcgtgggggagcgtggtccagccgtgggacgtcctgagactctctgtgacgcctctggattcagcttcagttacgtagttggtttgcgtcgttcgggtcccgccaggcctccgaggcaaaggggctggcgaggtgggtgcagtctaatatcagtagtaggaaaaagggtaacaacaaaattaaacgtacgttaacgacaagtaaaccgtcccggtaggaaacggggtccctaatttacccgaaacctacttaccctaccgaaggaacgaaaccaaacctaaccccaaaagtaaaccctaaccgtttaacttttacacccgttaggaaacctaaacgttacgaaaccctacccgtagtaacgtaccgttagggaacggtaaccgtacgggttctacggttactttaagttaagtttcgggcgagggtaacgggaggggtaataacgtccggaatccgaacgtaaccgg

SEQ ID NO: 322573 - DNA, 655 bp, Homo sapiens
  misc_feature: GZ8MTXP01BWZN7.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaccctacttattcttattcggtaccagcagaacgccaggccacggccctgtgttgttgatataataaagacactgagacggtccttacgagggtactcccgtaggacgcgtattcgtctccggcctccacgtcgagggaaacaagtcggtacactattacgacatacgaggtaggacgtccgaaggcaaggaagacggaggtctagtacttagtttctagttactaagttcttacgaatactagttcgtaggttagttaacctttgttcgttaccgtttacgggaaaccggtaacggggaacccttaaggggttcccttaacccggttaccggttaacgggttcccgaaccggttacccccgaaacgggtacccccctaaaccccgtacgttccgttacccgttaacccttcccgtttaacccccg

SEQ ID NO: 322574 - DNA, 632 bp, Homo sapiens
  misc_feature: GZ8MTXP01AY6Q2.51.6.A06.1.454.CMB.2.raw
  modified_base (399)..(399): a, c, t, g, unknown or other
  misc_feature (399)..(399): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcggtggtccagccgtgggacggtccctgacgactctcctgtgaacgcctctggattcagcttcagttacgtattgggtttgccgtcgtcggggtcccgccgagggtcctccgagggaccgaaagggggcctgggcgagggtgggggtcgcattcgtaatatacaatagtaggaaaaagggaanaacaaaataaactactacgacaacgactccgtaggaaacgggccgtaacttaccacctatcctaccaagaacgaacaacctaacccaaagaaccaacgttaactttactctacgacctaaagcgaaacccaccgtagtaagtacgttacggaacggtaaccgtacggttctcgttacgttaatttagttggttcggacggaaggaggggaagtacgtcggatccgaacgaacg

SEQ ID NO: 322575 - DNA, 530 bp, Homo sapiens
  misc_feature: GZ8MTXP01DZJOV.51.6.A06.1.454.CMB.2.raw
  modified_base (248)..(248): a, c, t, g, unknown or other
  misc_feature (248)..(248): n is a, c, g, or t
  modified_base (407)..(407): a, c, t, g, unknown or other
  misc_feature (407)..(407): n is a, c, g, or t
  modified_base (433)..(433): a, c, t, g, unknown or other
  misc_feature (433)..(433): n is a, c, g, or t
  modified_base (466)..(466): a, c, t, g, unknown or other
  misc_feature (466)..(466): n is a, c, g, or t
tcagcgatcgtatacacgaccggtgctcgatttagatctactgacagggggtctggggagaccgagcccagcactggaagtcgccggtgtttccattcggtgatcatcactgaacacagaggactcaccatggagttttggggctgagctggggtttttcctcgttgtcttctttttaagaggtgtccagtgtcaggtgcagctggtgcagtcgtgggggaggcgtggtccagcctgggagtccctgngactctcctgtgacgcctctggattcagcttcagttcgtatggtttgcgctgggtccgccaggctccgaggcaaggggactggcaggtgggtgcatctatatcatatgaaaaggtagcaaataaatactacgcagactcgtagaggcatcacatctcanacacactaccaagaacactactttanctagacaaatcgaacacctgagacttgagaacncgttactgttctaattgttagttgacggtaaggaggggtaacacgtacggataaccaacgaacg

SEQ ID NO: 322576 - DNA, 544 bp, Homo sapiens
  misc_feature: GZ8MTXP01CE109.51.6.A06.1.454.CMB.2.raw
  modified_base (297)..(297): a, c, t, g, unknown or other
  misc_feature (297)..(297): n is a, c, g, or t
  modified_base (525)..(525): a, c, t, g, unknown or other
  misc_feature (525)..(525): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggagtccctgagactctcctgtgagcctctggattcagcttcagtacgtatggtttgcgctgggtcccnccaggctccgaggcaagggctgcaggtgggtgcagtctatatcatataggaaaagaagcaaataaatactacgcagactccgtagaagggccatcaccatcctacagagacaactacccaaagacactactttatactagacaaatcgaaacctacccgtgaacgtacttacggaacggaacacgggcttggttaccttaattgttggttggacgtaaggaggggaanagtcggactcgaacgaacg

SEQ ID NO: 322577 - DNA, 643 bp, Homo sapiens
  misc_feature: GZ8MTXP01BUF0C.51.6.A06.1.454.CMB.2.raw
  modified_base (386)..(386): a, c, t, g, unknown or other
  misc_feature (386)..(386): n is a, c, g, or t
  modified_base (622)..(622): a, c, t, g, unknown or other
  misc_feature (622)..(622): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtgggaggtccctgagactctcctgtgagcctctggattcagcttcagttacgtagttggtttgccgtcgtcggggtcccgcccgaggcctaccgaggacgaaagggggctggcgtaggtggggtgctatctaatatcaagtagtaggaaaaaagggaanaactaaaataaaactaccgtaacgacaacgtaccgtccgtagggaacgggcctattaccacctataccctaccgaagaacgaaccaaactaccccaaagtaaacctaaccgttaacttttatacctaacgaacctaaaagtacgaaaccctaacccgtagaacgtacttagggaacggtaactacgggttcttaggttactttaagttaagttgttggacggaagggtaggggaanacgtcggactccgaacgaacg

SEQ ID NO: 322578 - DNA, 533 bp, Homo sapiens
  misc_feature: GZ8MTXP01A8R1J.51.6.A06.1.454.CMB.2.raw
  modified_base (375)..(375): a, c, t, g, unknown or other
  misc_feature (375)..(375): n is a, c, g, or t
  modified_base (506)..(506): a, c, t, g, unknown or other
  misc_feature (506)..(506): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
  modified_base (532)..(532): a, c, t, g, unknown or other
  misc_feature (532)..(532): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtcccagtgtcaggtgcagctggtgcagtcgtggggggaggcgtggtccaggcctggggaggtccctgagactctcctgtgaagcctctggattcagcttcagtacgtatggtttgcgctgggtcccgccaggctcaggcaaggggactgcaggtgggtgcatctatatcatatgaaaaggaagcaaataaatactacgnagactccgtagaagggccattcaccatctaccaagacaacaataccccaaagaaccacgactttaatcctagacaaaatcgaaaccaccctgaacgtacttaggaagaacacggctgttcgtattattggngagaaggaggaanancgatcgaacgng

SEQ ID NO: 322579 - DNA, 673 bp, Homo sapiens
  misc_feature: GZ8MTXP01EZH5I.51.6.A06.1.454.CMB.2.raw
  modified_base (531)..(531): a, c, t, g, unknown or other
  misc_feature (531)..(531): n is a, c, g, or t
  modified_base (598)..(598): a, c, t, g, unknown or other
  misc_feature (598)..(598): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggacggtccctgacgactctcctgtgaacgcctctggattcagcttcagttacgtagttgggtttgcgtcgtcggggtcccgccgaggcctcccgagggacaagggggactggacgtagggtggggtgactagttctaattatacaagttatagggaaaaaggaaagtctaaaattaaaactaccgtaaccggactaaggtaaccgtcccgggttaagaaacgggggtaccctatttacccaaccgtacttacctaccgaagaacaaccaactaaccccaaagaacctactaacgttttaanaccgtagaactaaacgtacgaaaccctaccgtagtaaacgtacgtacggaacggaacgtacgggttntacgttacttaacgtttagttggttacggaacgggtaagggacgggtaactaggtacgacgtaaccgaacgaacg

SEQ ID NO: 322580 - DNA, 668 bp, Homo sapiens
  misc_feature: GZ8MTXP01CRG3P.51.6.A06.1.454.CMB.2.raw
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctcgtggagatgcattcgacccaaccctattattcttattcggtaccagcagaacgccgaggccacggccctgtgttgttgatataataaagacacgtgagaggccttagagggactcccgtgagcgtattccctcgtcggcctcccgacctacgacgggaactaagtcggtacactagttacgacctagtacgtaggtacggacgtaccgaagggacgaaaggaacggacggtagggacttagtaactttacgtttcgtacgggttactaaacttccttaaccgagtaccctagtacgtagttggttaaccttagtcgtttacgttaaccgggtaacggttacggggtaacccgttaaacggttccgtaacccggttccgttacgggttacccgaacccggtaccccgaaaccgggaccccctaaccccgttacgttaaccggttccttaaccccg

SEQ ID NO: 322581 - DNA, 572 bp, Homo sapiens
  misc_feature: GZ8MTXP01CLXRQ.51.6.A06.1.454.CMB.2.raw
  modified_base (353)..(353): a, c, t, g, unknown or other
  misc_feature (353)..(353): n is a, c, g, or t
  modified_base (372)..(372): a, c, t, g, unknown or other
  misc_feature (372)..(372): n is a, c, g, or t
  modified_base (441)..(441): a, c, t, g, unknown or other
  misc_feature (441)..(441): n is a, c, g, or t
  modified_base (518)..(518): a, c, t, g, unknown or other
  misc_feature (518)..(518): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggaggtccctgagactctcctgtgagcctctggattcagcttcagtacgtatggtttgcgtcgtgggtccgccgaggcctccgaggcgaaaggggctggcgaggtgggtcgcatctatatcatanagaaaagaagcaaataaanctacgcagactcgtagaacgggccatcacatctaccagacgacaactacccaaagtaacactactttancctagaacaaatcgaacctacccgtgtaacgtacttaggacgaaccgacggttcttagttacttaagtttagttggnggttaccgggaagggaggggtaacgtagttacccggaattcccgaacgaaccgg

SEQ ID NO: 322582 - DNA, 555 bp, Homo sapiens
  misc_feature: GZ8MTXP01AI7JR.51.6.A06.1.454.CMB.2.raw
  modified_base (336)..(336): a, c, t, g, unknown or other
  misc_feature (336)..(336): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtcccccaggacagacggccaggatcacctgctctggagatgcattcgcccaaacccacttattcttattggtaccagcagaagccaggccaggcccctgtgttgttgatatataaagacactgagaggcctttcgagggatcccgtgagcgtattcnctcggcctccacctcgagggaacaagtggtcactattcgaccatacgagtggagtccaggacagaagacgagctagacttatttcagttcaattcttacagacattcgagttggttacttagtgttcgttacggaacgtgggaaccagggtccaaccggtccgtaggttccgacggaccccaaggaccccaacccgactcgacctaacttccgttcccg

SEQ ID NO: 322583 - DNA, 580 bp, Homo sapiens
  misc_feature: GZ8MTXP01BFZBW.51.6.A06.1.454.CMB.2.raw
  modified_base (212)..(212): a, c, t, g, unknown or other
  misc_feature (212)..(212): n is a, c, g, or t
  modified_base (383)..(383): a, c, t, g, unknown or other
  misc_feature (383)..(383): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctccccctctcactctctgcacaggctctgaggccctcctatgtgctgacacagcccaccctcggtntccgtgtccccaggacagacgccaggatcacctgctcgtggagatgcattcgacccaaccacttattcttattcggtaccagcagaacgccaggccacggcccctgtgtttgtgaatataataaagccactgagacggccttaagagggtctcccgtagacgtcgtattcncgtcggccttccacctcgaagggactaagtcggtacactattcgacctatacgaggtcggggtaacgcccgaaggaccgaagaacgacgaggtcctgtaacttatttcgtgtaactaaacttcttacgagtaactattacgaggttacggttaactttagtcgttacgttacgggaacgtcgggaaccgtaaccggg

SEQ ID NO: 322584 - DNA, 627 bp, Homo sapiens
  misc_feature: GZ8MTXP01B1SMF.51.6.A06.1.454.CMB.2.raw
  modified_base (311)..(311): a, c, t, g, unknown or other
  misc_feature (311)..(311): n is a, c, g, or t
  modified_base (383)..(383): a, c, t, g, unknown or other
  misc_feature (383)..(383): n is a, c, g, or t
  modified_base (491)..(491): a, c, t, g, unknown or other
  misc_feature (491)..(491): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcaggtcgtgggggaggcgtggtccaggccgtggggacggtccctgagactctcctgtgaagcctctggattcagcttcagttacgtagttggtttcgcgtcgtggggtcccnccgaggcctaccgagggacaagggggctggcgagggtgggtgctagtctatatcagtagaggaaaaaggaanaacgaaaataaataccgtacgacgaaggtacctacggtaggaacgggcctaattccaacctatccgtacaaggacaacaaactaccccaaagaacctactaactttanacctagaacctaaatcgaaaccacccgtagaacgtacgttacggacggaacctcggttccttagttccttaagttattcgggttacgacgggaagggaaggggtaactaacggtacgttactaaccgaacgtaacg

SEQ ID NO: 322585 - DNA, 643 bp, Homo sapiens
  misc_feature: GZ8MTXP01BTPFZ.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctccccctctcactctctgcacaggctctgacggcctcctatgtgctgacacacgcccaccgtcggtcgtccgtcgtaccccaggacagacgccaggactcacctgctcgtggagatgcattcgacccaaccctattattcttagttcgtaccagcaagacgccacggccacggtccctgttgttcgtagatataataaacgacacgtgacgacgtccttaagacggtctccgagacgcgtacttctcgtcgctacccacgtacgacgggtaactaagtcggtacaacgtacgttacgacctaagtaccgagggtacggggaacgttacccggaaagggaccgaaaggtaacgggaaccggaggtacccgttagttaaaccgtttaacgtttccgtacggttaactaactttcgttaacgaacgtaactcgttacgttagttacggttaacttcgtaacgttcccgtacgggttacgtcgggttaaacgtaacccggg

SEQ ID NO: 322586 - DNA, 637 bp, Homo sapiens
  misc_feature: GZ8MTXP01A5J23.51.6.A06.1.454.CMB.2.raw
  modified_base (488)..(488): a, c, t, g, unknown or other
  misc_feature (488)..(488): n is a, c, g, or t
  modified_base (594)..(594): a, c, t, g, unknown or other
  misc_feature (594)..(594): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccagccgtgggacgtccctgagactctcctgtgaacgcctctggattcagcttcagttacgtatggtttgcgtcgtgggtcccgcgacggcctccgagggcgaagggtactcggacgagggtgggggtcgactatctaatatacaatagtagaaaaacggaagtaacaaaataaactaccgtaacgcaaacggtacctaccggtaggaacggggaccctacttaccaacctagttacccaccgaagacgaaaccaaactacccaaaanaaacctaacttaactttaacgtactaacgaacctaaactacgaaacctacccgtagaacgtacgttagaacgaacgtaacggttctagttactaattattcggttnacgggtaaggagggtaagcgtacacgtaaccgaacgtaaccgg

SEQ ID NO: 322587 - DNA, 651 bp, Homo sapiens
  misc_feature: GZ8MTXP01A6L41.51.6.A06.1.454.CMB.2.raw
  modified_base (494)..(494): a, c, t, g, unknown or other
  misc_feature (494)..(494): n is a, c, g, or t
  modified_base (591)..(591): a, c, t, g, unknown or other
  misc_feature (591)..(591): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggaggcgtggtccagccgtgggacgtcctgagactctctgtgaagcctctggattcagcttcagttacgtagttggtttgccgtcgttggggtccccgccgaggccttccgagggacaagggggacctggcgtagggtgggtgctatcgtatatcaatatggaaaaaggaagcaaataaatactacgacaacggactccggtagaacggggtccaattccgaacctatacctacccgaagaacgaaccaaactacccaaaagtaacctaacgtaacttttaacncgttacgaacaaacgttcgaaacctaccctgaaaccgtacgttaggaacgggaacctacgggttacttacggttactttaaagttaagttttcgggnggaaccggttaaaggggacgggggttaaacgtaacgtacggttactaaccgaacgtaacg

SEQ ID NO: 322588 - DNA, 599 bp, Homo sapiens
  misc_feature: GZ8MTXP01AEJ2S.51.6.A06.1.454.CMB.2.raw
  modified_base (384)..(384): a, c, t, g, unknown or other
  misc_feature (384)..(384): n is a, c, g, or t
  modified_base (422)..(422): a, c, t, g, unknown or other
  misc_feature (422)..(422): n is a, c, g, or t
  modified_base (459)..(459): a, c, t, g, unknown or other
  misc_feature (459)..(459): n is a, c, g, or t
  modified_base (562)..(562): a, c, t, g, unknown or other
  misc_feature (562)..(562): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtgggggaggcgtggtccagccgtgggacggtccctgagactctcctgtgaacgcctctggattcagcttcagtacgtattggtttgcgtcgtgggtcccgccgaggcctccgaggcgaaaggggctggcgagggtgggtgctatctatatcaatagtagaaaaggaagcaaataaanactacgcagactccggagaacgggcctaatcacatccncaagacaacaactacccaaagaaccaacttactttanctacgaactaaagtcgaaaccctacccgtagaacgtacgttacggaacggtaaccacgggttcttagttaccttaagtttagttcgggttgacgggtaagggnggggtaatacgtacggttactaaccgaactaaccggg

SEQ ID NO: 322589 - DNA, 770 bp, Homo sapiens
  misc_feature: GZ8MTXP01C1DSO.51.6.A06.1.454.CMB.2.raw
  modified_base (262)..(262): a, c, t, g, unknown or other
  misc_feature (262)..(262): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgtgctgagcttgggttttcctcgttgctcttttaagaggtgtccagtgtcaggtgcagctggtgcaggtcgtgggggaggcgtggtccaggccgtggggacggtccctgagactctctgtgagcctntggattcagtcttcagtacgtatggttgcgcgtgggtccgccgaggcctccgaggacgaaggggactggcgtaggtgggtcgctagtccttatatcgaagttagtaaggaaaaggtaacgaactaaaattaaaacgttaccgaacgacgaaaggtacccgttaccggtagggaaacggggtaccctaacttaccaaacccgactttacccgtaacccaaagggaaaccgaaacccgaaacgttaaacccccaaaacggtaaaaccctaaaccctttaaaccgtttttaaacgtacccgttaagaaaccgtaaaaacttaccggaaaacccctaaccccgttaagggaaaccgtaaacccgtttagggaaacccggggtaaaccttaacccggggttacgtttaacggtttaaaccgtttaaagtttttacggtttcgggttacgggtaacggggtaaagggtaacggggttaaacggtaccgttaccggtaacgttaacccggtaacg

SEQ ID NO: 322590 - DNA, 569 bp, Homo sapiens
  misc_feature: GZ8MTXP01AQ2AY.51.6.A06.1.454.CMB.2.raw
  modified_base (426)..(426): a, c, t, g, unknown or other
  misc_feature (426)..(426): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtggggggaggcgtggtccagccgtggggagtccctgagactctcctgtgaacgcctctggattcagcttcagttacgtatggtttgcgtcgtggggtccgccgaggcctccgagggcaagggggctggcgaggtgggtgcatctatatcatagtgaaaacggagcaaataaagtactacgcagactccgtagaaacgggccattcaccatccgtaccaganacaactacccaaagaaccacgtactttaagtcctagaccaaatgaaacctacccgtgaacgtaccttaggaacgggaacaacgggccttaggttccgttaattattggttgacgaaggtagggaatagcggatccaagaacgg

SEQ ID NO: 322591 - DNA, 616 bp, Homo sapiens
  misc_feature: GZ8MTXP01CIU26.51.6.A06.1.454.CMB.2.raw
  modified_base (587)..(587): a, c, t, g, unknown or other
  misc_feature (587)..(587): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgcattcgacccaaccctattatttcttattcggtaccagcagaagccaggccacggccctgtgtgttgatataataaagacactagagaggtccttcgagggactcccgtgagcgtattctcgtcggcctccactcgaggaacaagtcggtacactattcgaacctatacgaggtaggacgtacccgaaggcaaaggaagacggaggtctaggtaacttagttcgtagtactaaagttctttacgagtaacctatccgtaagttaggttacttagtcgttacgttacggaacggtaacgggtaaccgttaaggtccgaccgttaccgtaggttacccgacgacccggaaaccgcccctaaaaccccgtntaccggttacctaaccgttccgttccccg

SEQ ID NO: 322592 - DNA, 530 bp, Homo sapiens
  misc_feature: GZ8MTXP01A91S6.51.6.A06.1.454.CMB.2.raw
  modified_base (304)..(304): a, c, t, g, unknown or other
  misc_feature (304)..(304): n is a, c, g, or t
  modified_base (352)..(352): a, c, t, g, unknown or other
  misc_feature (352)..(352): n is a, c, g, or t
  modified_base (504)..(504): a, c, t, g, unknown or other
  misc_feature (504)..(504): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaacccatattcttattggtaccagcagaagccaggccaggccctgtgttgttgatatataaagacactgagaggccttnagggatccctgagcgattctctcggctcactcagggaacaatggtcanattgaccatcagtgatccgaggcagaagacgaggctgacttattctagttcaattcttcagtacattcgagttggttacttatgtacttcgggaactgggaccaagggtccacggtcctaaggttccgacgcccgaaacgggccccaacccncgtcgttaccaaccttcgttccccgg

SEQ ID NO: 322593 - DNA, 753 bp, Homo sapiens
  misc_feature: GZ8MTXP01BLPI1.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcgttgggttttcctcgttgcttcttttaagaggtgtccagtgtcaggtgcagcgtggtgcaggtcgtgggggaggcgtgtccagccgtgggacgtccctgacgtctctctgtcgaacgtccctgtggtacttcagtcttacgaggttacgttagttggttcgccggtcggtcgggtccccgccgacggtcccgtaccggagggtaccgaaaggggtccgtcgggcggtagggggttcgggggtacgaccttaattaccgttaattaacgtactaagtaagtaagggaaaaaaaggtaaacgtaataaaaagtaaaactaccgtaacgcgtaaacggtaccgtacggagggtaaaccgggcctaacttacccactaacttccccgaaaccgaagaaccgaaaccaaaccgtaacccccgaaaataaccccttaacgttaaacgttttaacgacctaacgaaactaaacgtaccgaaacccgtacccgttaagaaaccggtaccgtaaggaacccggtaaaccgtcggttaccgttaagttaccgttaagtttacgttgggttgacgggaagggacgtaagtacgacgttaactaacccgaaggtaacccg

SEQ ID NO: 322594 - DNA, 590 bp, Homo sapiens
  misc_feature: GZ8MTXP01EWMCV.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaaccatattcttattggtaccagcagagcaggccagccctgtgttgtgatatataaagcactgagagccttcagggactccctgagcgtattctctcggcctaccaccgtcgacggggaacaagtcgggttacaacgtatttcgaaccctataccgaggttggaacgttacccgaagggccaaggaaaggaaccggagggtcctagacttatttctagttactaagtctttacagacatacagttaggttacttagtgttacgttacggaagtcgggaacttaacgggtccttaccggtccgttacggcgaccgacccgaacggccccaacccgacgtcgttacctaaccttcgtttaaccccg

SEQ ID NO: 322595 - DNA, 666 bp, Homo sapiens
  misc_feature: GZ8MTXP01DGX9I.51.6.A06.1.454.CMB.2.raw
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagccaccctcggtgtccgtgtccccaggacagacggccaggatcacctgctcgtggagatgcattcgacccaaaccctattattcttattcggtaccagcagaagccaggccaggcccctgtgttgtgatataataaagacactagagaggtccttacgagggactcccgtgagcgtattctctcggcctacacctcgaagggaaacaagtcggtacaactagtttacgacctagtcgaaggttacggacgtacccgaggaccaaggtaaacgaacgggagtaccgtaggtaacttactttccgtagttacctaaagttcctttaaccaaggtacctaattccgtaggttacggttaactttagttacgttaccgttacgggtaaacgtaacggggtaaccttaaacggggtcccaaacccggttaccgtaacgggttccgaaccgaccccggtaaaccggacccctaaacccctaccgtgttacccctaacgttccctttcccccg

SEQ ID NO: 322596 - DNA, 633 bp, Homo sapiens
  misc_feature: GZ8MTXP01AFY4F.51.6.A06.1.454.CMB.2.raw
  modified_base (217)..(217): a, c, t, g, unknown or other
  misc_feature (217)..(217): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtccccaaggacagacggccaggatcacctgctctgganatgctattcgacccaaaccctacttattcttattggtaccagcagagccaggccacggccctgtgttgtgatataataaagacactgagacggtccttacgaggtactcccgtagacgcgtacttctcgtccgcctcaccgtacgacggaactaagtcgtacaactacgttacgacctatacgtaggtacgggtacgtaccgaggacgtaaacggaacggaacggtacggtcgtacgtactttacgtttcgtacgttactaaacgttcttacgactaaccgtatccgtagtcggtttaaacttgttacggttacgttacggaacgttcgggaaccttacggtccaccggttacgtacggttcgaccgcccgaaaccgccccaacccgtacgccgttactaacctttccgttccccg

SEQ ID NO: 322597 - DNA, 601 bp, Homo sapiens
  misc_feature: GZ8MTXP01BPWFG.51.6.A06.1.454.CMB.2.raw
  modified_base (578)..(578): a, c, t, g, unknown or other
  misc_feature (578)..(578): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtcccccaggacagacggccaggatcacctgctctggagatgcattcgaccaaccctatattcttattcggtaccagcagaagccaggccaggccctgtgttgtgatatataaagacactgagaggccttacgagggactcccgtgagcgtattctctcggcctccactcgaggaacaagtggtacactattcgacctatcgaggtggacgtaccgagggcaaggaacggtacggaacggtcgtagtaccttatttccgtagtaccctaagttcctttacgaacgtacctaagttccgtaaggttcggtttaacttagtcgttacgttacggacgtaacgggaacttacggtccgttaccgtcgtacggttccgacggaccccaacggccccaacccgtntcgttcctaaccgttcgtccccg

SEQ ID NO: 322598 - DNA, 649 bp, Homo sapiens
  misc_feature: GZ8MTXP01AWNVY.51.6.A06.1.454.CMB.2.raw
  modified_base (382)..(382): a, c, t, g, unknown or other
  misc_feature (382)..(382): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggaggtccctgagctctcctgtgagcctctggattcagcttcagtacgtatggtttgcgtcgtcgggtcccgccgaggcctcccgagggccgaagggggactggccgtaggtgggggtggcctattcgtaatatcaagtataggaaaaagggaanaactaaataaaacgtacctaacggacacggacctccgggtaggaacggggccctaattccaacccatccgtaccaagaacgaaccaaactaccccaaagaaccaactactttaactctagaaccaaatcgaaaccacccgtagaacgtaccgttaggaacggtaaccgtaacgggttccttaggttaccttaaagtttacgttacgggttgggaccgggaaggggtagggggaactaacggttcggaacttccgaaaccgtaaccgg

SEQ ID NO: 322599 - DNA, 566 bp, Homo sapiens
  misc_feature: GZ8MTXP01A2PVV.51.6.A06.1.454.CMB.2.raw
  modified_base (462)..(462): a, c, t, g, unknown or other
  misc_feature (462)..(462): n is a, c, g, or t
  modified_base (508)..(508): a, c, t, g, unknown or other
  misc_feature (508)..(508): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtggggggaggcgtggtccagccgtggggacggtccctgacgactctcctgtgaacgcctctggattcagcttcagtacgtatggttgcgcgtcgggtcccgcaggctccgaggacgaaggggctgcgaggtgggtgcatcgtatatcatagtagaaaaggaagcaaataaactactacgacaagactaccggtagaacgggccgattccacctataccaccaagacgaacaactacccaaagaaccactaactttacnctacgtacaaaatcgaaacaccctgaacgtacgttaggacggaacncggttctgttactattagttgttgacgtaagggagggaacacgtcgactcgaacaacg

SEQ ID NO: 322600 - DNA, 652 bp, Homo sapiens
  misc_feature: GZ8MTXP01DZRX5.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtgggaggtccctgagactctcctgtgaagcctctggattcagcttcagtacgtatggtttgcgtcgtggggtcccgccgaggcctcccgaggccgaaagggggctggcgagggttggggtcgctatctatatcaatagtaggaaaaaggaagaactaaaataaaactaccgtaacggactaacggtacgttacccggtaggaagggtacccgtaattaccacctaactacctacccaagaacgaacaaactaaccccgaaagaacctacgtaacttttatcctacgaacctaaaatacgaaacctaccccgtagtaacgtaccgttaggaacggaacctaacgggccttaggttaccgttaatttagtttcggttggttaccgggaaggaaggggaacgtaagtaccggattaacgaacgaacgg

SEQ ID NO: 322601 - DNA, 671 bp, Homo sapiens
  misc_feature: GZ8MTXP01ESSON.51.6.A06.1.454.CMB.2.raw
  modified_base (259)..(259): a, c, t, g, unknown or other
  misc_feature (259)..(259): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtggggggagcgtggtccagccgtgggaggtccctgagactctcctgtgacgcctntggattcagcttcagttacgtagtggtttgccgtcgttcggggtcccgaccgaggcctacccgagggacgaaagggggtcctggcgtagggtggggtcgctaagttctaatatacgaattaagagggaaaaaagggaataactaaaataaaacgtaccgtaaccggacaaggtaccgtacccggtaggaaacggggtccctaattcccaacctatacctaccgaaggaacaacaaactaccccaaagtaaccacgttaactttaactacctaagaaacctaaacgtacgaaacctaccgtagtaacgtaccgtaggaacggtaacgtacggttcttacgttacgttaacgttagttcggttacggacgggaagggtaagggaagtaacgtacggactaaccgaacgtaacgg

SEQ ID NO: 322602 - DNA, 703 bp, Homo sapiens
  misc_feature: GZ8MTXP01CX4DQ.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggtttttcctcgttgcttcttttaagaggtgtccagtgtcaggtgcagctggtgcagtcgtgggggagcgtggtccagccgtgggacgtcctgagactctctgtgacgcctctggattcagcttcagttacgtagttgggtttgcggtcgtcgggtcccgccgaggcctacccgaggcgaagggggactggcgaggtgggtgacatcgtatatcatagtaggaaaaaaggaagaactaaaagtaaaactaccgtaacggacgtaaacgtaccgtacccggtagggaaacggggtacccgtaacgtttaccaacccgtacttaccgtaccccgaaaggtaaaccggaaaccaaacttaaccccccgaaaaaggtaaacccctaaaccgttaaaccctttttaacgtaaccttaacggaacctaaaaacgttccggaaaaccctaaccccgttaggaaaccgtaccgttaggaacggaaccgtacggttcttacgttcgttaaattgtttagggcggacggaagggagggaactacgtacgactaaccgaacgtaacg

SEQ ID NO: 322603 - DNA, 638 bp, Homo sapiens
  misc_feature: GZ8MTXP01EM9RX.51.6.A06.1.454.CMB.2.raw
  modified_base (605)..(605): a, c, t, g, unknown or other
  misc_feature (605)..(605): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtggggacgtccctgagactctcctggtgaacgcctctggattcagcttcagttacgtagttggttgccggtcgtcgggtcccgccgaggcctccgaggacgaaaggggtctggacgtagggtggggtgctatacgtaactagtacaagttaagtaggaaaaaaggaacgaactaaaagttaaaactacgtaaccgcgaaacggtacctacccggtaggaaacgggtacctaagtaccaacctacgtacctaccaaggaacaaacaaactacccaaagaacctaacgtaactttaacactagaactaaactacgaaacccacccgtagaacgtaccgttaggaacgtaacgaacggttcttagttacttattagttgnggagtaaggagggaacagtacgatcgaagaacg

SEQ ID NO: 322604 - DNA, 682 bp, Homo sapiens
  misc_feature: GZ8MTXP01DQ4ZZ.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaaacccattattcttattggtaccagcagaagccaggccaggcccctgtgttgtgatataataaagacactgagaggccttacgagggactccctgagcgtattctcgtcggccttaccaccgtcgacgggaaactaaagtcggtacaaactattacgaacctatacgaggttacggacgtacccgaaggaccgaaaggtaaacggaaccggaggtcgtacggtaacttaacgtttctagttaacctaaagtttcctttacgaaacgtaacctaattaccgtaaggtttacggtttaaacctttagttacggttaccgttaaccgggtaaacgttaacggggtaaacccgttaaagggtacccttaaccggttaccgtaacgggttaccaaccggaccccgaaacgggccccaaacccctacgtacgttacctaacccgttaaccgtttcccccg

SEQ ID NO: 322605 - DNA, 623 bp, Homo sapiens
  misc_feature: GZ8MTXP01EVVST.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccattattcttattggtaccagcagaagcaggccaggccctgtgttgtgatatataaagacactgagaggccttcgagggactcccgtgagcgattctctcggctcactcagggaacaagtcggtacactattgaacctagtcgaggtagggacgtaccgagggacaaggaaacgacggaggtctacgtaacttactttcgtagttacctaaagttcctttacgaacgtaacctaagttccgtaaggtttcggttaacctttaagtcggtttaccggtttacgggaacgttaacggggaaacccttaaggggtaccttacccgtacgtaacgggttacgacggaccccgaacgggccccaaaccccagtcgttacctaaccgttccttaaccccg

SEQ ID NO: 322606 - DNA, 662 bp, Homo sapiens
  misc_feature: GZ8MTXP01EXRGG.51.6.A06.1.454.CMB.2.raw
  modified_base (370)..(370): a, c, t, g, unknown or other
  misc_feature (370)..(370): n is a, c, g, or t
  modified_base (532)..(532): a, c, t, g, unknown or other
  misc_feature (532)..(532): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcaggtcgtgggggaggcgtggtccagccgtggggacggtccctgacgactctctgtgagcctctggattcagcttacgagttacgtagttgggtttcgcggtacgtcggggtccccgccgtaggccctacccgagggaccgaaagggggcctggacgtagggttcgggggngactattcgtaaatatacaagtaagtacggaaaaaagggtaacaactaaaattaaacgactaccggaataacggtaccgtcccggtaagggaacgggtcctataccaacccattaccgtaccaagacaacctaacctacccaaaagtaaccactaactttanacgtacgaataaaatccgaaacctaccgtagtacgtacgttaggcggaaactcggttcttacggttacttaagttaagttggacggacgtaaggggtacggaagtcgtacgaacttccgaacggtaaccg

SEQ ID NO: 322607 - DNA, 609 bp, Homo sapiens
  misc_feature: GZ8MTXP01BZ5J7.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaaccctacttattcttattggtacccagcagaagccaggccaggcccctgtgttgttgatataataaagacactgagaggccttcgagggactccctgagcgtattctctcggcctccacctcgaggaaccaagtggtacactagttcgaccatcgagtggagtccgaggcaaggaagacggaggctagacttattctgtactaagtcttacaagtacctatcgtaggttggttaactttgttcggttcgttacgggaacgtcgggggtaaaccttaacggggttccaacccggttccgtaacggttaccgaaccggaccccgtaacgggaccccctaaacccctcgttacgttaccctaacccttccgtttaacccccg

SEQ ID NO: 322608 - DNA, 683 bp, Homo sapiens
  misc_feature: GZ8MTXP01BZMHR.51.6.A06.1.454.CMB.2.raw
  modified_base (261)..(261): a, c, t, g, unknown or other
  misc_feature (261)..(261): n is a, c, g, or t
  modified_base (298)..(298): a, c, t, g, unknown or other
  misc_feature (298)..(298): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggaggcgtggtccagccgtgggacggtccctgagactctctgtgagcctgngatcagctcagtacgtatggttgcgtcgtgggtcccncgaggctccgaggacgaagggtctgcgagggtgggtgctatctaagtactacaagtaacgtaggaaaaaagaacgtaacctaaaattaaaacgtaccgtaaccgacgtaaacgtacccgttacccgggttagggaaaccggggtacccgtaacttaccaacccgtattaccccgtaccgaaacggaacgaaccctaaaaccgtaccccgaaaagtaacccttaaccgttaaacgtttttaacaccgtacggtaaacctaaacgtccgaaaccctacccgtaggtaaccgtacgttacggaacggaaccgtcggttacttagttacgtttagttaagttggaggttcggaagggaggaacgtatacggactaaccaacggtaaccg

SEQ ID NO: 322609 - DNA, 597 bp, Homo sapiens
  misc_feature: GZ8MTXP01A5LKK.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattcgccaaacccatattcttattggtaccagcagaagccaggccaggccctgtgttgttgatatataaagacactgagacggcttcgagggactccctgagcgtattctcgtcggcctccacctcgaggggaaacaagtggtacactagttcactatcagtggagtccaggcaagaagacggagctagacttatttcctgtactaaacgttcttcaagtaactactccgtaagttgggtttaaccttaagttcgttacgttaccgggaaacgttcggggaacccgttaaggttcccacccggttaccgtaacgggttccacgaccccgaacggccccaaaccccgtacgtcgttacctaaccgttccttaaccccg

SEQ ID NO: 322610 - DNA, 532 bp, Homo sapiens
  misc_feature: GZ8MTXP01ANVGY.51.6.A06.1.454.CMB.2.raw
  modified_base (435)..(435): a, c, t, g, unknown or other
  misc_feature (435)..(435): n is a, c, g, or t
  modified_base (480)..(480): a, c, t, g, unknown or other
  misc_feature (480)..(480): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggaggtccctgagactctcctgtgaagcctctggattcagcttcagtacgtatggtttgcgctgggtccgcaggctccgaggcaaggggctgcaggtgggtgcagtctatatcaatataggaaaaggagcaaagtaaactactacgcagactccgtagacggccgatcaccatctcagagacaactacccaaagaacacgtactttanctacgacaaatcgaaaccaccctgagtacctgaacggaacacggntcgttctattattggttcgaggaaggagggaacgagtccgatcgaacgaacg

SEQ ID NO: 322611 - DNA, 801 bp, Homo sapiens
  misc_feature: GZ8MTXP01CI9M7.51.6.A06.1.454.CMB.2.raw
  modified_base (261)..(261): a, c, t, g, unknown or other
  misc_feature (261)..(261): n is a, c, g, or t
  modified_base (304)..(304): a, c, t, g, unknown or other
  misc_feature (304)..(304): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggagcgtggtccaggccgtgggacgtccctgacgactctctgtgagcctntggattcagcttcagttacgtatggtttgcgtcgtgggtcccnccgaggtcctccgaaggcgaaagggggacctgggaccgtagggtcgggggtggactattccttaatactacaagtagtaggaaaaaagggaaacgaactaaaatttaaacgtaccgtaaccggactaaacggtaccgttaccccgggttaagggaaccggggtacccgtaaactttacccgaaacccctaacgttaccccttaccccggaaaaggtaaccgtaaaaccctaaaacctaaccccccgaaaaggtaaaaacccctacccggtttaaacttttttaactaccggttaacgaaaaccgtaaaaccttacggaaaaccctaaacccccgttggaaaccggttacttaacgggaaacggtaaacccgtaaccgggttcctttacggttactttttaaaacggttgttttaggggttcccgggaaacgggttaagggggtaaagggggaacctttaaacggtacccgaagttaacccccggaaagtaacccggg

SEQ ID NO: 322612 - DNA, 600 bp, Homo sapiens
  misc_feature: GZ8MTXP01AQSBP.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctccccctcctcactctctgcacaggctctgaggcctcctatgtgctgacacacgccaccctcggtgtccgtcgtccccaggacagacggccaggactcacctgctcgtggagatgcattcgacccaaaccctattacttcttattcggtaaccagcaagaacgcccaggcccacggcccctgttgttgtgatataataaacgacctacgtagagtacggcccttagacgggtaactcccgtgacgcgtattcgtctcggcctccacctcgagggacaagtcgtacacgtactcgaccagttaccgaggtacggggacgtacccgaggaccgaaaggaacggacggaggtcctaggtacttatttccgtgtaacctaattccttagaacgtacacgttgagttcggtttaactagttgtaccttacgggttacgtcgggttaaccgttaaccggg

SEQ ID NO: 322613 - DNA, 608 bp, Homo sapiens
  misc_feature: GZ8MTXP01EOSSE.51.6.A06.1.454.CMB.2.raw
  modified_base (591)..(591): a, c, t, g, unknown or other
  misc_feature (591)..(591): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccagccgtgggacgtccctgagactctctgtgagcctctggattcagcttcagttacgtagtggtttgcgtcgtcgggtcccgccgacggcctccgagggacgaaggggactggcgagggtgggtcggctagtctaatatcaagtataggaaaaaggaagctaaaataaactactaacgacaagacgtaccgtaggaacgggacctattccaacctatcctaccaagacgaacaaactacccaaagaaccctaacgttaactttaatactacgaaactaaacgtacgaaacctacccgtagtaacgaccgttaggacggaacgtaacgttcttagttactattagttggttgacggtaaggagggtaanagtcgatcgaacgaacg

SEQ ID NO: 322614 - DNA, 633 bp, Homo sapiens
  misc_feature: GZ8MTXP01C9JQT.51.6.A06.1.454.CMB.2.raw
  modified_base (493)..(493): a, c, t, g, unknown or other
  misc_feature (493)..(493): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtggggaggtccctgagactctcctgtgaagcctctggattcagcttcagttacgtattgggtttgcgtcgtggggtcccgccgaggtccgtccgaagggccgaaagggggactggccgagggttgggggtggacagtcctaatatacataagtaggaaaaagggaagaactaaaataaatactacgacaagtacctccgtaggaacggggcctattaccactatcctacagaacgaacaactacccaaagaaaccactaactttanactagaacctaaatcgaaccacccgtagagtacgttggaacggtaaccaacgggttcttcggttaccttagtttaagtttaggttgggttaccggtaagggagggggaagtaggttacggacttaaccgaaccgtaacgg

SEQ ID NO: 322615 - DNA, 635 bp, Homo sapiens
  misc_feature: GZ8MTXP01DROAE.51.6.A06.1.454.CMB.2.raw
  modified_base (255)..(255): a, c, t, g, unknown or other
  misc_feature (255)..(255): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctcctatgtgctgacacagcccacccgtcggtgtccgtgtccccaggacagacggccaggactcacctgctctgganatgcattcgacccaaacccactattcttattggtaccagcagaacgccaggccacggcccctgtgttgttgatataataaagccactgagacgtccttaacgagggtctcccgtagacgcgtattcgtcgtacgcctccaccgtcgacgggactaagtcggtacaactagttacgacctatacgtaaggtggggacgttacccgaaggacgaaacggaaacggacggtaaggtaccttaggtaactttacgtttcgttacggtaacctaaagttcgtttaccaaaggtaaccctaagttaccgttaaggtttacgggttaacctttagttaacggtttacgtacgggttaacgttaacggggttaacccgttaaaccggg

SEQ ID NO: 322616 - DNA, 591 bp, Homo sapiens
  misc_feature: GZ8MTXP01E042Z.51.6.A06.1.454.CMB.2.raw
  modified_base (484)..(484): a, c, t, g, unknown or other
  misc_feature (484)..(484): n is a, c, g, or t
  modified_base (535)..(535): a, c, t, g, unknown or other
  misc_feature (535)..(535): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggaggcgtggtccagccgtggggacgtcctgagactctcctgtgacgcctctggattcagcttcagttacgtagttggtttgcgcgtcgggtcccgccgaggcctccgaggacgaaaggggacgtgacgaggtggggtggctatctaatatcaatagtgaaaaaggagaacaaataaatacgtacgacagactacgtaggaaacgggccgtaacttcgaacctatacctaccaaggaacaacaaactaaccaaacgaaacctaactaactttaanctacgaacaaatcgaaaccacccgtagaagtacctggaaggaaccgacggnttcgttactattaagttgttggcggaagggagggaagtcgtacgatcgaacgaacg

SEQ ID NO: 322617 - DNA, 554 bp, Homo sapiens
  misc_feature: GZ8MTXP01EXRZE.51.6.A06.1.454.CMB.2.raw
  modified_base (411)..(411): a, c, t, g, unknown or other
  misc_feature (411)..(411): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaaacccattattcttattggtaccagcagaagccaggccaggcccctgtgttgttgatataataaagacactgagacggccttcgagggactcccgtgagcgtattctctcggcctccactcgacgggaacaatggtcaactattcgaccatcaggtgacgtcaggcaagagacgagctgacttnttctgtctaagtcttacagtacatcgtagtcggtactttagtcgttacttcggaagtcgggtaacagggttcccaccgttacgtacgttcgacgacccgaaccggcccaaaccccgctcggttacctaaccgttcgttccccg

SEQ ID NO: 322618 - DNA, 730 bp, Homo sapiens
  misc_feature: GZ8MTXP01AODC6.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctccccctctcactctctgcacaggctctgaggcctcctatgtgctgacacacgcccacccgtcggtcgtccgtcgtccccaggacagacggccaggactcacctgctcgtggagatgcattcgacccaaccctacttattcttagttcggtacctagacagaacgccgacggccgacggtcccctggttcgtttgttgtaatataaataaagaccacgtagagacggtccgttaacgacgggtaactcccgtaggtacgacggtacttctccgttacggccctttacccgacccgttacggaacggggtaactaacgttacgggtaccacgttaacgttacgaaacccgtgttaccgtaagggttcgggggtaaccgttaccgggaacggtacgaaaacggaaacgggaaccggtacggtaccgttaacgtaaccgttttacgtttcgttaacgtaaccttaaacgtttcctttacgaacggttacctaagtttcgttaaaccggtttagggtttaaaccctttaggttaaccggtttaccgttaccgggttacggttaaccgggttaaacccgttaacccggg

SEQ ID NO: 322619 - DNA, 705 bp, Homo sapiens
  misc_feature: GZ8MTXP01CBI5K.51.6.A06.1.454.CMB.2.raw
  modified_base (240)..(240): a, c, t, g, unknown or other
  misc_feature (240)..(240): n is a, c, g, or t
  modified_base (309)..(309): a, c, t, g, unknown or other
  misc_feature (309)..(309): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgaggtcgtgggggagcgtggtccagccgtgggacgtccngagactctcctgtgaagcctctggattcagtcttcagttacgtattggtttcgcgtcgtcggggtcccnccgaggcctaccgagggtacgaaaggggctgggcgagggtgggtgacagttactaatatcgaattaagaggaaaaaaggaacaactaaaaattaaaactacgtaaccgactaacggaccgttcccggtaagggaacgggtacctaacttacccaacctaacgtacctaacccgaaaggaaacgaaaccctaaaaccgtaaccccgaaaaagtaaacccttaaaccgttaaacccgttttttaaacgtaaccgtaaacgaaacctaaaacgtaccgaaaccctaacccgtagtaacgtacgtacggaacggtaacgtacggttcttaacgttacgttaagttcgttaggttcggacgggtaaggaagggtaagtacgtacgactaacgaacgtaacg

SEQ ID NO: 322620 - DNA, 549 bp, Homo sapiens
  misc_feature: GZ8MTXP01ELG0J.51.6.A06.1.454.CMB.2.raw
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
  modified_base (544)..(544): a, c, t, g, unknown or other
  misc_feature (544)..(544): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggaggcgtggtccagccgtgggacggtccctgagactctcctgtgaagcctctggattcagcttcagttacgtagttggtttgcgcgtgggtcccgccgaggcctccgaggcaaggggactgcaggtgggtgcatctatatnatagtgaaaagggaancaaataaatactacgcaagactccgtagagggccatcacatactccaagacgaacaactaccaaagaacactactttatactacgacaaatcgaaacctaccctagacgtaactggaacggaacacggttctagttctattagttgttgaggtaaggagggaagtatacgataacgngaacg

SEQ ID NO: 322621 - DNA, 643 bp, Homo sapiens
  misc_feature: GZ8MTXP01BJD41.51.6.A06.1.454.CMB.2.raw
  modified_base (567)..(567): a, c, t, g, unknown or other
  misc_feature (567)..(567): n is a, c, g, or t
  modified_base (620)..(620): a, c, t, g, unknown or other
  misc_feature (620)..(620): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccagccgtgggacgtccctgagactctctgtgacgctctggatcagctcagtacgtatggtttgcgcgtcgggtcccgcgaggctccgaggcgaaggggctggcaggtgggtgcagtctatatcaatagtaggaaaaaggaacgaacaaataaaactaccgaacgtacaagtaccgttaccggtaggaaacgggcccgtaattccaaccctacttacctacccgaagaaccgaaccaaactacccccgaaagaaaccctaaccgtaacttttaactaccttacgaacctaaaacttcggaaaccccttaccccgtagggtaaacgtaccgttagggaaccgggaacncgggttcgttacgttacttaagtttagttacggttggacgaagggtagggaanacgtacggactaacgaacgaacg

SEQ ID NO: 322622 - DNA, 552 bp, Homo sapiens
  misc_feature: GZ8MTXP01B5BF5.51.6.A06.1.454.CMB.2.raw
  modified_base (442)..(442): a, c, t, g, unknown or other
  misc_feature (442)..(442): n is a, c, g, or t
  modified_base (530)..(530): a, c, t, g, unknown or other
  misc_feature (530)..(530): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtcccccaggacagacggccaggatcacctgctctggagatgcattcgacccaaaccctacttatttcttattcgggtaacccagaccaagaacgccaggccaggcccctgtgttgttgatataataaagacactgagacggtccttacgagggactcccgtgagcgtattctctcggcctcacgtcgaggaacagtgcatattcgactatcagtgagtccgaggcaagagacgagctgacttattctagtactaagttcttanagactatcgtagtggttaacttgtgtcgtacggagtcggacttaaggtccgaccgtcgtaggttccgacgacccgaacgcccaacccntcgacctaacttccgtaacccg

SEQ ID NO: 322623 - DNA, 727 bp, Homo sapiens
  misc_feature: GZ8MTXP01CGLH9.51.6.A06.1.454.CMB.2.raw
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccaggcctgggacgtccctgagctctcctgtnaacgcctntggatcagcttcgagtacgtatggtttgcgcgtgggcccaccgaggcctacgaggcgaaaggggctggcgagggtgggtggactatcctaatatnaagttanaggaaaaaacgggaaactaactaaaagtaaactacgtaacgacgaacgtacgtaccggtaaggaacgggtacctaacgttacccaacctaactacccgtacgaacgaacgaaaccgtaaaccgtaacccaaaacgtaaacctaaacgttaaacgttttaactaccgtaaacggaaacctaaaacgtaaaccgtaaacccgtaaacccgtaacgtaacgtaacggtaacggtaacggtaaccggtaaccggttaccgttacgttaacgtttaaacgtttaacgtttacgggttacgggttacgggtaaacggggtaaaggggtaacgggtaacggtaaccggttaacgtaaccgttaacccgtaaccg

SEQ ID NO: 322624 - DNA, 781 bp, Homo sapiens
  misc_feature: GZ8MTXP01EEXQQ.51.6.A06.1.454.CMB.2.raw
  modified_base (262)..(262): a, c, t, g, unknown or other
  misc_feature (262)..(262): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggaggcgtggtccagccgtgggacgtccctgacgctctcctgtgaacgcctntggattcagcttcgagttacgtagttgggtttgccggtcgttcggggtaccccgccggaacggtccgttaccccggaaggggaccgaaaacgggggtaccgttcgggtaccgtaagggggtttcggggggtacggacctaagttaccttaaattaactacgtaaagttaacgtaaggggaaaaaaaagggtaaacggtaacctaaaaaagtttaaaaaccgtaaaccgttaaacccgggacctaaacgggtaaaccgttccccggggtaaaggaaaccgggggtaccctaacttacccaaccctaagttaccctaacccgaagaaccgaaaccaaaccgtaacccctaaaagaaacctaaccgttaacttttaactactacgaaaccaaataccgaaacctaaccccgttagaaaccgtacgttacggaacggtaaccgtacgggttcttagttacgttaagtttagttcggttggaacggtaagggagggaacgtagtccggataaccgaacgaaccg

SEQ ID NO: 322625 - DNA, 751 bp, Homo sapiens
  misc_feature: GZ8MTXP01EMX1S.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggatcacctgctctggagatgctattcgacccaaacccattattcttattcggtaccagcagaagccaggccacggccctgtgttgtgatataataaagacactgagacggtccttacgagggtactcccgtgagcgtattctcgtcggcctaccacctcgaagggaacctaaagtcggtactaactactttacgaaccctagtccgtaagggtcggtaacgtacccgaagggaccaaagggtaaacgggaaccgggtaggggtaccttaaggttaaccgtttaattttccgttaggttaaccttaaaacgtttctttaaccggaaagttaacctagttaccgtaagggtttgggtttaaaccttttagttacggtttaaccggtttaccggggtaaacggttaaccgggggtaaacccgttaaaacggggttccccgttaaaccccgggttacggtaaccgggttaccgaaacccggacccccgaaaaccgggaccccctaaacccccgtaacgttccggttaccctaaccctttccccggtttaacccccg

SEQ ID NO: 322626 - DNA, 615 bp, Homo sapiens
  misc_feature: GZ8MTXP01CGW1O.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccagccgtggggacgtccctgagactctcctgtgaacgcctctggattcagcttcagttacgtatggtttgcgcgtggggtcccgcaggctccgaggcaaggggctgcgaggtgggtgctatctatatcaatatgaaaaagggaagcaaataaactactacgacaacgactcccggtaggaacgggcctagttccaacctactctaccaagacgaacaactacccaaagaactaccgtaactttatacgtacgaaccaaacttcgaaacctaccccgtagaacgtaacgttacggaacgggtaacctaacggggttcttacgttaccgttaagtttacgttggttcgggaggtaagggtagggggtaacgacgtacgactaaccgaacgaacg

SEQ ID NO: 322627 - DNA, 512 bp, Homo sapiens
  misc_feature: GZ8MTXP01B6IX4.51.6.A06.1.454.CMB.2.raw
  modified_base (357)..(357): a, c, t, g, unknown or other
  misc_feature (357)..(357): n is a, c, g, or t
  modified_base (388)..(389): a, c, t, g, unknown or other
  misc_feature (388)..(389): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaaccactattcttattggtaccagcagaagccaggccaggcccctgtgtgttgatatataaagacactgagaggccttcagggatccctgagcgatctctcggctcacctcagggaacaatggtcacattnaccatcagtgagtccaggcagaagacgaggnngatattntntnatctnananatnagtagtatatgtcgtcgtacgtaacggacgaacgtacgaccgtacgtacgttacgttacgacgaacgacccgaacccactacgttactaaccttcgtccg

SEQ ID NO: 322628 - DNA, 703 bp, Homo sapiens
  misc_feature: GZ8MTXP01C21PI.51.6.A06.1.454.CMB.2.raw
  modified_base (308)..(308): a, c, t, g, unknown or other
  misc_feature (308)..(308): n is a, c, g, or t
  modified_base (402)..(402): a, c, t, g, unknown or other
  misc_feature (402)..(402): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggagcgtggtccagccgtgggagtccctgagactctcctgtgaagcctctggattcagtcttcgagttacgtagttggtttcgcgtcgtcggggtcccnccgaggcctcccgagggcgaaagggggcctggacgtagggttggggtcgactattccttaagtactcgaattaagtaggaaaaaaagggtaaanaaccgtaaaaattaaaacgtaacctacggacctaagggtaccctaccgggtaggaaacgggtccctaattaccaaccctaatcccttaacccgaaaggaacaaacccaaacctaaccccgaaaaacgaacccctaaacgtttaaccttttaactaccgttacgaaacctaaaacgtaccgtaaacctaccccgttaggaaaccgtacgttaggaacggaaccgtacggttccttagttacctttaagttgttaggttcggacgggtaaggacgggtaagtcgtacggactcgaacgtaacg

SEQ ID NO: 322629 - DNA, 531 bp, Homo sapiens
  misc_feature: GZ8MTXP01D0I38.51.6.A06.1.454.CMB.2.raw
  modified_base (215)..(215): a, c, t, g, unknown or other
  misc_feature (215)..(215): n is a, c, g, or t
  modified_base (308)..(308): a, c, t, g, unknown or other
  misc_feature (308)..(308): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattcgccaaacccattattcttaattcggtaccagcagaagccagccaggcccctgtgttgttgatatataaagacactgagagccttnaggatccctgagcgattctctcgctcactcaggaacaatggcacattgaccatcagtgatccagcagaagacgaggctgactattcgtatacaatcttcagacatctagtaggtacttattgttcgttacggtaacgtaacggtaacgaacggtacgttaccgtaccgtacgttacgacgaccgaacggaccaacccacctacgttctaacgttcgttccccg

SEQ ID NO: 322630 - DNA, 614 bp, Homo sapiens
  misc_feature: GZ8MTXP01D07L3.51.6.A06.1.454.CMB.2.raw
  modified_base (308)..(308): a, c, t, g, unknown or other
  misc_feature (308)..(308): n is a, c, g, or t
  modified_base (503)..(503): a, c, t, g, unknown or other
  misc_feature (503)..(503): n is a, c, g, or t
  modified_base (554)..(554): a, c, t, g, unknown or other
  misc_feature (554)..(554): n is a, c, g, or t
  modified_base (593)..(593): a, c, t, g, unknown or other
  misc_feature (593)..(593): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggaggcgtggtccagccgtgggacgtcctgacgactctctgtgaagcctctggattcagtcttcagttacgtagttggtttgcgtcgttcgggtcccncgaggcctccgaaggacgaaggggctggcgaggtgggtgctatctatatacgaagtagtaggaaaaaggtaagaactaaaataaactaaccgacgacaagaccgtaccggtaggaaacggggccctattaccaacctagtacctaccgaaagtaacgaacaaacctaacccaaaagaacctaacgtaacttttanactagaacaaatacgaaacctacctgaacgtactcggagaaccgtcggttntacgttatagtttagttggttacgacggaagacgggaanacgtagactaacgaacgaacg

SEQ ID NO: 322631 - DNA, 558 bp, Homo sapiens
  misc_feature: GZ8MTXP01B9H93.51.6.A06.1.454.CMB.2.raw
  modified_base (455)..(455): a, c, t, g, unknown or other
  misc_feature (455)..(455): n is a, c, g, or t
  modified_base (541)..(541): a, c, t, g, unknown or other
  misc_feature (541)..(541): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtggggggaggcgtggtccaggccgtggggaggtccctgagactctcctgtgaagcctctggattcagcttcagtacgtatgggtttgcggtctggggtcccgccgaggcctccgacgggcgaaaggggctggcgaggtggggtgcatctatatcatataggaaaaggaagcaaataaatactacgcaagactccgtagaacggcgatcacatctaccagacgacaactaccaaagaaccactaactttanactacgacaaatcgaaacaccctagtagacttgacggaacaacggcttacgttcttaagtttgttgttggacgtaaggagggtaanagtcgatccgaagaacg

SEQ ID NO: 322632 - DNA, 674 bp, Homo sapiens
  misc_feature: GZ8MTXP01DP92W.51.6.A06.1.454.CMB.2.raw
  modified_base (192)..(192): a, c, t, g, unknown or other
  misc_feature (192)..(192): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggtttttcctcgttgctcttttaagaggtgtccagtgtcagggtncagctggtgcagtcgtgggggagcgtggtccagcctgggagtcctgagactctcctgtgaagcctctggattcagcttcagttacgtagttgggtttgcgtcgtcggggtcccgccgaggcctccgaggcgaaagggggacttggcgaggtgggggttgcgatctaatatcataagtacggaaaaaggaaacgaactaaaataaaactaacgtaccgacgtaacgaaccgttcccggtaggaaacggggtcccgtaattccaacctaatacctaccgaagaacgaacaaacctaacccaaagtaaccaacgtacttttaactctaacgtaacaaaatacgaaacctaccccgtagtaacgtacgttacggaacggtaaccgaaacggttctacggttacctttaagtttaacgtttaggttggaccgggtaaggggacggggtaagtaacggttacggaacttaacccggaactaacccggg

SEQ ID NO: 322633 - DNA, 632 bp, Homo sapiens
  misc_feature: GZ8MTXP01B4TOE.51.6.A06.1.454.CMB.2.raw
  modified_base (334)..(334): a, c, t, g, unknown or other
  misc_feature (334)..(334): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggagcgtggtccaggccgtggggacgtccctgagactctcctgtgagcctctggatcagcttcagtacgtatggtttgcgcgtgggtccgccgaggctccgaggcgaagggctgcaggtgggnggcagtctatatcatatgaaaaggaagcaaagtaaactactaaccgcgaagtacctaccgggtaggaacgggccgtaattcccaacctacgtacctacccgaagaacgtaaccaaactaccccaaaagaaaccctaactaactttttaatacctacgtaaccaaaattcgaaaccctaacccctaggtaaacgtacgttaggaaccgggtaaccacgggttcttacggttacctaagtttaagttcggttagggacggtaaggggtagggaagtagtacggactaacgaaccgaacgg

SEQ ID NO: 322634 - DNA, 540 bp, Homo sapiens
  misc_feature: GZ8MTXP01EYSXI.51.6.A06.1.454.CMB.2.raw
  modified_base (420)..(420): a, c, t, g, unknown or other
  misc_feature (420)..(420): n is a, c, g, or t
  modified_base (512)..(512): a, c, t, g, unknown or other
  misc_feature (512)..(512): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaaccatattcttattggtaccagcagaagccaggccaggcccctgtgttgtgatatataaagacactgagaggccttcgagggactccctgagcgtattctctcggcctccacctcgagggaacaatgtcacattgaccatcagtgagtccgaggcagaagacgaggctgactgttctgtacaagttcttaganacatcagttggtaacttatgtcttacggaacgttcgggaaccttaaggtccaccgtcgtacgggttacaccgacccgaacggcccaaccccnctcgttacctaaccgttcgttaaccccg

SEQ ID NO: 322635 - DNA, 679 bp, Homo sapiens
  misc_feature: GZ8MTXP01EK93K.51.6.A06.1.454.CMB.2.raw
  modified_base (346)..(346): a, c, t, g, unknown or other
  misc_feature (346)..(346): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagcgtgggttttccgtcgttagctcttttaagaggtgtccagtgtcaggtgcagctggtgcagtcgtgggggagcgtggtccagccgtgggaggtccctgagactctcctgtgacgcctctggattcagcttcagttacgtatgggtttgcgtcgtgggtccccgccgagggcctcccgaggcaaaggggctgcgaggttgggngcatcctaatatacatataggaaaacggaaagaactaaaataaactacgtacgacgacggtacctacggtaggaacggtcctacgtaccacctacgtacctacgaagaacgaaccaacctaaacccgaaacgtaaacctaaaccgtttaacgtttaactaccgtaacgtaaacctaaacgtaaccgtaaacccgtaacccgtacgtaacgttaacgtacgggaaccggtaacgtacggttacgttacgtttacgttaaagtttacgttacgggttacgggaacgggaacgggtaaggggtaacgtaacgtaccgttacgtaaccgaacgaacg

SEQ ID NO: 322636 - DNA, 747 bp, Homo sapiens
  misc_feature: GZ8MTXP01EKIOJ.51.6.A06.1.454.CMB.2.raw
  modified_base (191)..(191): a, c, t, g, unknown or other
  misc_feature (191)..(191): n is a, c, g, or t
  modified_base (326)..(326): a, c, t, g, unknown or other
  misc_feature (326)..(326): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtncagctggtgcaggtcgtgggggaggcgtggtccaggccgtgggacgtccctgacgaccttctcctgtacgaacgccttcgtggtattcagtcttacgaagttacgtagttgggtttcgcgtcgttggggtccccnccgaggtcctaccgaaggaccgaaagggggtctggcgagggtgggtcgactagttctaatatcaagtagtagggaaaaaaagaaacgtaactaaaaattaaaactaccgtaacgacgtaaggaacccgttaccggaagggaaacggggacctaacttaccaacctactacctaccaaagaaccgaaacaaacaacccgaaaacgaaaccctaacgttaacttttaactcctaacgaacctaaaacgtaccgtaaacctaaccccgtagtaaccgtaacgttcggaaacggtaaccgtaacgggttccgttacgtttactttaaacgttttaggtttacgggttaacggttaaccggggtaaaggggaaacgggggttaaacggaaccgttacccggaaacttaacccgaaacgtaacccgg

SEQ ID NO: 322637 - DNA, 671 bp, Homo sapiens
  misc_feature: GZ8MTXP01AUCWV.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcgaggtgcagctggtgcagtcggtgggggaggcgtggtccaggccgtgggacggtccctgagactctctgtgacgcctctggattcagcttcagtacgtagtggtttgcgtcgtcgggtccgccaggcctaccgaggacgaaggggactggacgaggtggggtcgctaatcgtaatatcgaatagtaggaaaaagaagaactaaaataaactacctaacgacaacggtacctacggtacggaacgggacctaattacccaacctattacccaccgaaagaacgaaaccaaactaccccgaaaagtaaccctaaaccgttaacttttaacgtaccttagaaacctaaaacgttccgaaaaccctacccgtagaacgtacgttacggaacggtaacgaccggttacgttacgttacttaagtttacggttggttacgggttacggaaggggagggtaagtaacgtaccggaataacgaacgtaaccgg

SEQ ID NO: 322638 - DNA, 560 bp, Homo sapiens
  misc_feature: GZ8MTXP01CEW9X.51.6.A06.1.454.CMB.2.raw
  modified_base (216)..(216): a, c, t, g, unknown or other
  misc_feature (216)..(216): n is a, c, g, or t
  modified_base (411)..(411): a, c, t, g, unknown or other
  misc_feature (411)..(411): n is a, c, g, or t
  modified_base (530)..(530): a, c, t, g, unknown or other
  misc_feature (530)..(530): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctgganatgcattcgacccaaacccacttattcttattggtaccagcagaagccaggccaggcccctgtgttgtgatatataaagcactgagaggccttcgagggactcccgtgagcgtattctctcggcctcacctcgagggaacaagtcggtcacattgaccatcaggtgacgtccaggcagaagacgaggctgacttnttctgtacaattcttacagacatcgagttaggttacttagttgtcgttcggaaccgtggggaaccttaagggtccaccgttccgtaggttcccgacgccccgaacggccccaaaccccncgtcgttccctaaccttccgtttaaccccg

SEQ ID NO: 322639 - DNA, 662 bp, Homo sapiens
  misc_feature: GZ8MTXP01DJ18M.51.6.A06.1.454.CMB.2.raw
  modified_base (322)..(322): a, c, t, g, unknown or other
  misc_feature (322)..(322): n is a, c, g, or t
  modified_base (633)..(633): a, c, t, g, unknown or other
  misc_feature (633)..(633): n is a, c, g, or t
  modified_base (644)..(644): a, c, t, g, unknown or other
  misc_feature (644)..(644): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgcttcttttaagaggtgtccagtgtcaggtgcagctggtgcagtcgtgggggaggcgtggtcagccgtggggacgtccctgacgtactctcctggtcgaacgcctacgtggtattcagtcttacgagttacgtagttgggtttgccggtcgtcggggtcccnccgaggtcctacccggaaggtacgaaagggggctggacgtaggggttgggtcgactattacctaattatacgtaattagtaaggaaaaaacggaaagtaactaaaaattaaacgtaactaaccgacgaacggtaccgtccggtaagggaacgggtacctattaaccgacctattaccgaaccgaaggaacaaaccaaacctaaccgaaaactaaacctacgttaactttatactacgaaactaaactccgaaaccaccgttagaacgttaccgtggaacggtaacgcggttcttacttagttattgttggngaggaaggagngactcgatccgaagaacg

SEQ ID NO: 322640 - DNA, 625 bp, Homo sapiens
  misc_feature: GZ8MTXP01AJ77Q.51.6.A06.1.454.CMB.2.raw
  modified_base (309)..(309): a, c, t, g, unknown or other
  misc_feature (309)..(309): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggagcgtggtccagccgtgggacggtccctgacgactctccgtgtgaacgcctctggattcagcttcgagttacgtattggttgcgtcgtcgggtccnccgaggctccgaggcgaaagggctgcaggtgggtgcatctatatcaatagtaggaaaaaggaagaactaaataaaatactaacgctaacgaccgtaccggtaggaacgggacccgtaacttaccaaccctagtacccgtaaccgaagaacgaacccaaactaaccccgaaaagaaccctacgttaaactttaactaccttaacgaactaaacgtacaaaccgtaccctagacgtacgtaggacggaacgcggttctattacgttagtttagttggttcgaggaaggtaggaagtacgtacgataacgaacgaaccg

SEQ ID NO: 322641 - DNA, 558 bp, Homo sapiens
  misc_feature: GZ8MTXP01AV6UN.51.6.A06.1.454.CMB.2.raw
  modified_base (358)..(358): a, c, t, g, unknown or other
  misc_feature (358)..(358): n is a, c, g, or t
  modified_base (538)..(538): a, c, t, g, unknown or other
  misc_feature (538)..(538): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgaagcctctggattcagcttcagtacgtatggtttgcgctgggtccgcaggctccgaggcgaagggctgcgaggtggggtgcatctatatcatatacggaaaagggaancaaataaactactacgcacgactccggagaacgggccattaccaccatcctcaagacgaacaactacccaaagaaccaactactttaacgctagacaaagtcgaaaccaccctaggacgtacgttaggaacggaactaacggctggttcttagttagttgttggcgtaaggaggggtaanagtacgataacgaacgaacg

SEQ ID NO: 322642 - DNA, 590 bp, Homo sapiens
  misc_feature: GZ8MTXP01BINXK.51.6.A06.1.454.CMB.2.raw
  modified_base (378)..(378): a, c, t, g, unknown or other
  misc_feature (378)..(378): n is a, c, g, or t
  modified_base (492)..(492): a, c, t, g, unknown or other
  misc_feature (492)..(492): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctctttaagaggtgtccagtgtcaggtgcagctggtgcagtcgtggggggagcgtggtccagccgtggggacgtcctgacgactctctgtagagcctgtggattcagcttcagttacgtagtggttgccgtcgtcgggtcccgccgaggcctaccggaggacgaaagggggctggcgtagggtgggtgactatctatatcaatagtaggaaaaggaanaactaaataaactactacgacaagaccgtccggtaggaacgggcctattaccaaccattaccaccgaagacgaactaacacccaaagaccactactttagacctagaactaaancgaacacccgtgacgtacgtaggaacgaaccagggttctagttacttaagttagttggcggaggaagggaggtaacgagtccggatccgaacgaacgg

SEQ ID NO: 322643 - DNA, 558 bp, Homo sapiens
  misc_feature: GZ8MTXP01AILCR.51.6.A06.1.454.CMB.2.raw
  modified_base (543)..(543): a, c, t, g, unknown or other
  misc_feature (543)..(543): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttatggtaccagcagaagccaggccaggccctgtgttgttgatatataaagacactgagaggccttgagggtatccctgagcgattccctcgtggcctccacctcgagggaacagtggtcactattcgaccatcagtggagtccgaggacagaagacgaggcttacgaacttatttactggtactaaattccttacaagacatacgagttggtacttagtgttcttaacggaattcgggaccttaaaggtccaacccgttccgttgggttaccaacggaccccgaaacggcccctaaacccccncgttccgttctcccg

SEQ ID NO: 322644 - DNA, 780 bp, Homo sapiens
  misc_feature: GZ8MTXP01EUF0G.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtcccgtgtcccccaggacagacggccaggatcacctgctcgtggagatgctattcgacccaaaccctacttattcttagttcggtaccagcaagaacgccaaggccaggtcccctgtgttgttagatataataaagacactgaagcggtaccttcgaggggtactcccgtgagcgtatttccgtcgtcggcctccaaccgtcgaacggggaaacctaaagttcgggttacccaaactacgttttacgaaccctaagttccgaaggttacgggaacgttacccgaaggggaccaaagggaaaggtaaaccggacggggtaccttacggaacctttattttacgtacgttaaccctaaagtttcctttacgaaacgtaacctaagttacccgtaaggttacggtttaaccctttaagttcggttacccggtttaccggggtaaaccgttaacgggggtaaaccccgttaaaggggttccccgttaaaccgggttaaccccgtttcgggaaccccgttaacccggaacccccgggtaaaaaccgggcccccctaaaaacccccggtccgttacccggttaccccgtaaccttttccccgtttaacccccggg

SEQ ID NO: 322645 - DNA, 636 bp, Homo sapiens
  misc_feature: GZ8MTXP01ENCMV.51.6.A06.1.454.CMB.2.raw
  modified_base (305)..(305): a, c, t, g, unknown or other
  misc_feature (305)..(305): n is a, c, g, or t
  modified_base (575)..(575): a, c, t, g, unknown or other
  misc_feature (575)..(575): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagtactctctgtgagcctcgtggattcagcttacagttacgtagtgggtttgccgtcgtggggtcccnccgaggcctcgaggcgaagggctgcgaggtggggtgctagtctaatatacaattagtaggaaaaaggaagaactaaaataaaacgtacctaacgactaacggaacctcccgggtagaaacggggccctaattccgaaacccattacctacccgaagaaccgtaaacaaacctacccaaaagaacctaacgtaactttaacacgtacgaaactaaacgtccgaaacctacccgttagaacgtaccgttagggaacggtaactaccgggttntacggttacttaatttaagttcgttggacggaaggagggaactagtacgactcgaagaacg

SEQ ID NO: 322646 - DNA, 623 bp, Homo sapiens
  misc_feature: GZ8MTXP01EKT6Z.51.6.A06.1.454.CMB.2.raw
  modified_base (608)..(608): a, c, t, g, unknown or other
  misc_feature (608)..(608): n is a, c, g, or t
tcagcgatcgtatacacgaccggtgctcgatttagatctactgacaggggtctgggagacgagcccagcattggaagtcgccggtgtttccattcggtgatcatcactgaacacagaggactcaccatggagtttgggctgagcttgggtttttcctcgttgcttcttttaagaggtgtccagtgtcaggtgcagctggtgcagtcgtgggggaggcgtggtccaggccgtgggacggtccctgacgactctcctggtgaagcctcgtggattcagtcttcagttacgtattggtttgcgtcgtgggtcccgccgaggctccgaggacaaggggactggcgtaggtgggtgctagtctatatcaatagtagaaaaggaagctaaaattaaatacgtacgacgaagaccttaccggtagaaacggggtccctagttacccaacctactccgtaccaagtaacgaaccaactacccaaagaaccactaactttataccctagaactaaactacgaaaccctaccgtagtaacgtaacttggaacggaacgtacggttacttggttaaccttagtttaagttggttcggaggaagggtacgggaagtacgngacgtcaacgtaacg

SEQ ID NO: 322647 - DNA, 509 bp, Homo sapiens
  misc_feature: GZ8MTXP01DY9QX.51.6.A06.1.454.CMB.2.raw
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
  modified_base (422)..(422): a, c, t, g, unknown or other
  misc_feature (422)..(422): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
  modified_base (466)..(466): a, c, t, g, unknown or other
  misc_feature (466)..(466): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (499)..(499): a, c, t, g, unknown or other
  misc_feature (499)..(499): n is a, c, g, or t
  modified_base (501)..(502): a, c, t, g, unknown or other
  misc_feature (501)..(502): n is a, c, g, or t
  modified_base (506)..(506): a, c, t, g, unknown or other
  misc_feature (506)..(506): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccagccgtggaggtccctgagactctctgtgaagcctctggattcagcttcagttacgtatggtttgcgcgtggtccgcaggctccgaggacaaggggactgcaggtgggtcgnatctanatacatagtagaaaacggaancaaataaactactacgacagacgtaccgtgaacgggcctaatccactatactcagaanacaaactcccaaagacatacttanacctananaancacacntanatgagaacngntnttntagtgngngagaagagnannatcngcg

SEQ ID NO: 322648 - DNA, 734 bp, Homo sapiens
  misc_feature: GZ8MTXP01EODE1.51.6.A06.1.454.CMB.2.raw
  modified_base (396)..(396): a, c, t, g, unknown or other
  misc_feature (396)..(396): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccagccgtgggacgtccctgacgtactctcctgtgaacgcctctggattcagcttcagttacgtagttggttgcgtcgtcgggtccgccgacggcctaccggaggtacgaaggggtactggcgagggttgggtgacagttctaatatacaataagtaggaaaaaacgggtaaanaacgtaaaattaaaacgtacccgtaaaccgacgtaaacggtaacccgttaccggtaaggaaaccgggtcccgtaacgtttacccaacccgtaacttacccgtaacccgaaagtaaaccggaacctaaacctaaccccgaaaagaacccgtaactaaccctttaaactttacctaacgtaacgaaaccgtaaacggtacctaaaccccgtacggtacgtaaacgttacggttaacgggaaccggtaaaccgttccggtagtttacgttaacgtttaagtttacggttggttacggaacgggtagggaacgggtagtacgttacgtaacttaacgaaccg

SEQ ID NO: 322649 - DNA, 573 bp, Homo sapiens
  misc_feature: GZ8MTXP01BYS0W.51.6.A06.1.454.CMB.2.raw
  modified_base (514)..(514): a, c, t, g, unknown or other
  misc_feature (514)..(514): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctccccctctcactctctgcacaggctctgacggcctcctatgtgctgacacacgcccaccgtcggtcgtccgtcgtccccaggacaggacgccaggactcacctgctcgtggagatgcattcgacccaacccattattcttattggtaccagcaagaacgccgaggccacggccccttgtcgtttgtagataataataaagaccagtagagacgtccttaacgacgggtctccgtagacgtcgtattcgtcgtcgctccaccgtgacggactagtcgcactatcgacatcaggtcgggacgtacgagacgaagaacgacgagtctagtacttactttcgagtaactaacgttccttacgagtaacctnttacgttgttacgttaacttagtcgttacgtacggttaacgtcggaaccgttaaccggg

SEQ ID NO: 322650 - DNA, 537 bp, Homo sapiens
  misc_feature: GZ8MTXP01BR9XR.51.6.A06.1.454.CMB.2.raw
  modified_base (522)..(522): a, c, t, g, unknown or other
  misc_feature (522)..(522): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctggggttttcctcgttgctcttttaagaggtgtccagtgtcaggtgcagctggtgcagtctggggggaggcgtggtccaggcctggggaggtccctgagactctcctgtgaagcctctggattcagcttcagtacgtatggtttgcgctggggtccgccaggctccaggcaagggctgcaggtgggtggcatctatatcatatgaaaagggaagcaaataaagtactacgcagactccgtagaagggccgaattcaccatactccaagagacaactaccccaaagaaccacgactttaatcctagacaaactgaaccaaccctgaagaccttgacgggaacaacggttctagttctattattgttgcgaaggagggngatcgatcaacaacg

SEQ ID NO: 322651 - DNA, 524 bp, Homo sapiens
  misc_feature: GZ8MTXP01AV6KX.51.6.A06.1.454.CMB.2.raw
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
  modified_base (467)..(467): a, c, t, g, unknown or other
  misc_feature (467)..(467): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtgggagtccctgagactctcctgtgagcctctggattcagcttcagtacgtatggtttgcgctgggtccgcgaggctcgaggcgaagggctgctaggtgggtgcagtctatatcaagtatgaaaagggaagcaaataaatactacgcagactccgagaaggccgatcaccatctacagacgacaatacccaagaacactactttanctagacaaatnaacaccctgacgtatgaggaacncggctgttctattattcggttgacggtaaggagggaagtagtcgatccgaacgaacg

SEQ ID NO: 322652 - DNA, 768 bp, Homo sapiens
  misc_feature: GZ8MTXP01BV0PS.51.6.A06.1.454.CMB.2.raw
  modified_base (260)..(260): a, c, t, g, unknown or other
  misc_feature (260)..(260): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggaggcgtgtccagccgtgggacgtccctgagactctctgtgaacgcctntggattcagtcttgagttacgtagttgggtttcgccggtcgttcggggtccccgaccgtacggtccctacccggaaggggtaccgaaagggggtaccttgggaccgtaggggttcgggggttcggactaacgtttactaattactactaaagttaacgtaaaggaaaaaaagggaaacgtaactaaaaaatttaaaaccgtaacccgtaaaccggaccgaaacgggtaccccgttaacccgggtaagggaaacggggtcccctaaacttcccaaacccgtacttaccctacccaaagggaaccaaacctaaaacccgtaccccaaaagtaaacccctaaccgtttaaactttacgaccttaacgaaacctaaaagtccgaaacccctacccggtagtaaaccgtagtacggaacggaaccgtacgggttcttacggttactttaaagttacgttacggttaggacggtaagggaggtaacgtagtaccggactaacccgaagaaccgg

SEQ ID NO: 322653 - DNA, 846 bp, Homo sapiens
  misc_feature: GZ8MTXP01D2OR4.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagctggtgcgagtcgtgggggagcgtcggtccaggccgtgggacgtccctgacgtaccttctcctgtcgaacgccttcgtggattcagtcttacaggttacgtagttggtttcgccggtcgttcggggtaccccgccgacggtcctacccgaagggaccgaaacgggggtcttcgggacgtaggggttcgggggttacgacctaacgttcttaaatacttacgtaaagttaagtagggaaaaaaacgggtaaactaacctaaaaattaaaaacgttacccgtaaaccggacgtaaacggtaaacccggtttacccgggtaagggaaaccggggtacccgtaactttacccgaaaccctaactttaacccgtacccgtaaagggaaaccgtaaaccaaaacccggttaaccccgaaaaaagtaaaccccttaaccgtttaaaaccttttttacgtaaacccgtttaacgaaaaccgttaaaaccgttaccgaaaaacccctaaccccggtttaggaaaccgttaaccgttacggaaacgggaaacccgtaacgggttctttacggttacctttaagttttacggttacgggttcggaaacgggtaagggtaaggggaaccttaagtacccggttaaactaaccgaaccgtaacg

SEQ ID NO: 322654 - DNA, 673 bp, Homo sapiens
  misc_feature: GZ8MTXP01DGJXW.51.6.A06.1.454.CMB.2.raw
  modified_base (305)..(305): a, c, t, g, unknown or other
  misc_feature (305)..(305): n is a, c, g, or t
  modified_base (390)..(390): a, c, t, g, unknown or other
  misc_feature (390)..(390): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggagcgtggtccagccgtgggagtccctgagactctcctgtgaagcctgtggattcagcttcagttacgtattggtttcgcgtcgtcggggtcccnccgaggcctcccgagggacgaaaggggctggcgaggttgggggtcgctagtcttaatagtcaagttaagtaggaaaaaagggaanaactaaaattaaaagtaaccgtaacgactaaggaccgtcccggtaggaaacggggccctaattaccaacctaactacctacccgaagaacgaaccaaactacccgaaaagaaccctaagtaacccttttaatccttaacgaactaaaacgtcgaaacctaaccccttaggaaccgtacgttacggaaaggtaaccgaacgggttccttaggttaccttaaagtttagttacggttgaccgggaagggaacgggtaagtaactccggaattccgaacggtaacg

SEQ ID NO: 322655 - DNA, 616 bp, Homo sapiens
  misc_feature: GZ8MTXP01BSUFQ.51.6.A06.1.454.CMB.2.raw
  modified_base (260)..(260): a, c, t, g, unknown or other
  misc_feature (260)..(260): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtggggacgtccctgagctctcctgtgaagcctcnggattcatctcagttacgtatggtttgcgtcgtcgggtcccgccgaggtccacggacgacggacgtcgcgagtcgggtaggtcgatactacgtatatactagtaagaggaaaagacgaataaaactaacgtaccgacgacgtaacgtacgtacggaacggacggtactactaccaactacttacccgacgtaacgaacaaacctacccgaaacaaacgtaactacgttaacttactacgaataaactaacgaacgtaccctaacgagtacgtacgtacgacgaaccgtacgttgtcgttattagttgttacgcggaggtaagggagggtaatacgtacgttactaaccgcgaaccg

SEQ ID NO: 322656 - DNA, 502 bp, Homo sapiens
  misc_feature: GZ8MTXP01DD3NR.51.6.A06.1.454.CMB.2.raw
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (423)..(423): a, c, t, g, unknown or other
  misc_feature (423)..(423): n is a, c, g, or t
  modified_base (490)..(490): a, c, t, g, unknown or other
  misc_feature (490)..(490): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcaattgcccaaacccactattcttaattggtaccagcagaagcaggcaggccctgtgttgttgatatataaagacactgagaggcttcagggatccctgagcgattctctcggctaccacctcaggggaacaaatggtcacattgaccatcagtgagtccaggcagaagagaggctgactattctagtcaaatcttanananatnagtagtatatgtcgtcgagtaaggacgacgtcgacgtcgtcgttacgcgaccaacgaccaacccacncttctcttctcg

SEQ ID NO: 322657 - DNA, 619 bp, Homo sapiens
  misc_feature: GZ8MTXP01B6MJ0.51.6.A06.1.454.CMB.2.raw
  modified_base (275)..(275): a, c, t, g, unknown or other
  misc_feature (275)..(275): n is a, c, g, or t
  modified_base (379)..(379): a, c, t, g, unknown or other
  misc_feature (379)..(379): n is a, c, g, or t
  modified_base (490)..(490): a, c, t, g, unknown or other
  misc_feature (490)..(490): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccagccgtgggacgtccctgacgactctctgtgacgcctctggattcagcttnagtacgtattgggtttgcgtcgtcgggtcccgccgaggcctccgaggacgaaggggactggcgtagggtgggtgctatctatatcaatagtaggaaaaggaaanaactaaaataaatacgtaacgacgaacgtaactcccggtaggaaacgggtcctaattccaacctatcctaccaagaacgaacaactaacccaaagaacctactaactttanactagaaactaaagtcgaaacctacccgtgtaacgtacgttacggaacggaaccgtaacggttcttacgttacttaagtttagtttggcgagggtaaggacggaagtactaccggatccgaagtaaccg

SEQ ID NO: 322658 - DNA, 624 bp, Homo sapiens
  misc_feature: GZ8MTXP01AK5GQ.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctcctatgtgctgacacacgccaccctcggtgtccgtgtccccaggacagacggccaggactcacctgctctggagatgcattcgacccaaccacttattcttattcggtaccagcaagaacgccaggccacggcccctgtcgttgttagatataataaagaccactgagacggtccttacgagggtctcccgtagacgctattctcgtcgcctccaccgtcgaacgggtactaagtcggtaccaacgtacttaccggaaccctagtaccgtaaggttacggggaacgtacccgaagggaccgaaaggtaaacggacggaacggtaccgttacggtaacctttatttccgtagtaacctaaagttccttacgacgtaactacttcgttagttacggttaactttagtcgttaccgttacggttaaccggttcggaaccgtaaccgg

SEQ ID NO: 322659 - DNA, 610 bp, Homo sapiens
  misc_feature: GZ8MTXP01BPLQP.51.6.A06.1.454.CMB.2.raw
  modified_base (216)..(216): a, c, t, g, unknown or other
  misc_feature (216)..(216): n is a, c, g, or t
tcagcgatcgtatacacgaccggtgctcgatttagatctactgacagggggtgggtccaggaggcagaactctgggtgtctcaccatggcctggatccctctacttcctcccctcctcactctctgcacaggctctgaggcctcctatgtgctgacacagccaccctcggtgtccgtgtccccaggacagacggccaggatcacctgctcgtgganatgctattcgacccaaaccctacttattcttagttcggtaccagcagaagccaggccacggccctgtgttgttgatataataaagacactgagagccttgaggactcccgtgagcgtattctctcggctccaccgtcgagggaaacaagtcggtacaactattcgaacctagtctaggtggagtccgaaggacaaggaaagacggacggtctagtacttatttctagtactaattcttaggataccgtattccgaggttacggttactttaagttcggttaccgttacgggaacgtaacgggtaaccttaaagggttcccgaacgttccgtaaggttaccgacgaccccgaacggaccccaaccctcgtcaccgtaaccgttcctttaaccccg

SEQ ID NO: 322660 - DNA, 581 bp, Homo sapiens
  misc_feature: GZ8MTXP01A4QT8.51.6.A06.1.454.CMB.2.raw
  modified_base (256)..(256): a, c, t, g, unknown or other
  misc_feature (256)..(256): n is a, c, g, or t
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaaccactattcttattggtaccagcagaanccaggccacggccctgtgttgttgatatataaagcactgagaggccttcgaggactcccgtgagcgtattctctcggacctccactcgaggaacaagtgtcacattgaccatcaagtgacgtccgagcagaagtacgaggntgacttattcgtntacaagtcttaccgaanactagtacgtagttacgttacttagtcgttaccgttacgggtaaccgtaacgggtaaccgttacggtacccgttaccgtacgtaacgttaccgaccggaccccgaaccggacccctaaaccccgacgttaccgttacctcccgttcccgtcccg

SEQ ID NO: 322661 - DNA, 592 bp, Homo sapiens
  misc_feature: GZ8MTXP01CHZ15.51.6.A06.1.454.CMB.2.raw
  modified_base (215)..(215): a, c, t, g, unknown or other
  misc_feature (215)..(215): n is a, c, g, or t
  modified_base (293)..(293): a, c, t, g, unknown or other
  misc_feature (293)..(293): n is a, c, g, or t
  modified_base (473)..(473): a, c, t, g, unknown or other
  misc_feature (473)..(473): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctcgtgganatgctattcgacccaaccctattattcttagttcggaccagacaagaacgccgacggccgacggtccctgtgttgtanaattaataataaagacacgtaggaggtacggtccttaggaggtactcccgtagagaccgtattctcgtccggcctaccactacggaaggaaacaagtgtacaactatcgacagtcaggtacgacgaccgagagaagaagacgacgctacgacttattctgtaactaacgttcttacgaanactatagtagtagttactagtcgtacgtacgtacgtaacggtaacgttacgtaccgttaccgtacgtacgacgaccgaccgaaccgacccaacccacctacgttacctccttccgtccg

SEQ ID NO: 322662 - DNA, 534 bp, Homo sapiens
  misc_feature: GZ8MTXP01EPGZI.51.6.A06.1.454.CMB.2.raw
  modified_base (301)..(301): a, c, t, g, unknown or other
  misc_feature (301)..(301): n is a, c, g, or t
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
  modified_base (383)..(383): a, c, t, g, unknown or other
  misc_feature (383)..(383): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (483)..(483): a, c, t, g, unknown or other
  misc_feature (483)..(483): n is a, c, g, or t
  modified_base (501)..(501): a, c, t, g, unknown or other
  misc_feature (501)..(501): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcgaggtcgtgggggaggcgtggtccagccgtgggacgtccctgagctctctgtgagctctggattcagcttcagtacgtagtggtttgcgtcgtgggtcccnccgaggcctccgaggcgaagggggactggcaggtgggngcatctatatcatanggaaaagaanaactaaataaacacacganacgacgtacgtagacgactatcacactcacagacacaacacaanacacgtacttancanacaacacaacctacgtgtacgtacgtagaacgaacgcgttntgttactagttagttggngaggaaggaggaagagtacgactaacgaacgcg

SEQ ID NO: 322663 - DNA, 579 bp, Homo sapiens
  misc_feature: GZ8MTXP01DI8VY.51.6.A06.1.454.CMB.2.raw
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
  modified_base (440)..(440): a, c, t, g, unknown or other
  misc_feature (440)..(440): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagcttgggttttcctcgttgcttcttttaagaggtgtccagtgtcagggtgcagctggtgcaggtcgtgggggagcgtggtccagccgtgggacgtccctgagactctcctgtgagcctctggattcagcttcagttacgtattggtttgcgcgtgggtcccgcaggctccgaggcaaagggctgcaggtgggtgnatctactatcatagtagaaaagggaancaaaataaatacgtacgacaaggactcggtagaagggccaattccaacactctaccagacgaacaactaccaaanaaacctactactttaatacacgacaaaatcgaaactacccgtagaacgtaaccttggaacggaaccaacgggttccttaggttacttaagtttagttggttggacgaaggaggggaatagtcggactaacaacgaacgg

SEQ ID NO: 322664 - DNA, 516 bp, Homo sapiens
  misc_feature: GZ8MTXP01A827D.51.6.A06.1.454.CMB.2.raw
  modified_base (268)..(268): a, c, t, g, unknown or other
  misc_feature (268)..(268): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
  modified_base (425)..(425): a, c, t, g, unknown or other
  misc_feature (425)..(425): n is a, c, g, or t
  modified_base (475)..(475): a, c, t, g, unknown or other
  misc_feature (475)..(475): n is a, c, g, or t
  modified_base (496)..(496): a, c, t, g, unknown or other
  misc_feature (496)..(496): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtcccgtgtcccccaggacagacggccaggatcacctgctctggagatgcattgccaacccatattcttatggtaccagcagagcagcaggccctgtntgtgatatataaagcactgagagccttcagggatccctgagcgattctctcggctcactcagggaacaatggtcactattgaccatcagtggagtccaggcaagaagacgaggntgactattcngtacaattcttnagacatcngtaggttaacttntgttacttcggaacttggggaaccttaaggtccgacgtccgtaggttccncgttcccgaagcccaaccccnctcgttacaacttcgtcccg

SEQ ID NO: 322665 - DNA, 616 bp, Homo sapiens
  misc_feature: GZ8MTXP01AGDCP.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattcgacccaaaccctattattcttaattcggtaccagcaagaacgccacggcctacggtcccctttgtgttagatataataaagacacgtgaggacggtccttacgagggtactcccgtgacgcgttattcctcgtcggtcccctacccacgtcgaacgggactaaaagtcggtaacactattacgactatacgaggtcgggacgtaccgaggacaaggaagacggaggctagtacttattctacgtactactcttacagtacatcgtagtgttacttagtcgttcgtacggaacgttgggaacctaggttccgtaccgttcgtaacggtaccacggacccaaccgggaacccctacccgaacgttcgtaccttccgttcccgttcccgttcccccg

SEQ ID NO: 322666 - DNA, 754 bp, Homo sapiens
  misc_feature: GZ8MTXP01BDLLS.51.6.A06.1.454.CMB.2.raw
  modified_base (574)..(574): a, c, t, g, unknown or other
  misc_feature (574)..(574): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtgggacggtccctgacgactctctgtgacgcctctggattcagcttcgagttacgtattgggtttgccgtcgttcggggtcccgccgagggtcctaccgaggtacgaaagggggtcctgggaccgtaggggttggggggttacgacctaagttccgttaaagttaactaccgtaaagttaaacgtaggggaaaaaaaacggggaaacgaactaaaaaagttaaaactaaaccgtaccggaacgtaaacggaccgttaccggtacggaaacgggcccgtaattcccaacctataccctaccgaagaacgaaccaaactacccaaacgtaacctaacgtaacttttaanacgttacgaacctaaacttacgaaaccctaacccctaggtaaaccgtaacgtttacgggaacggttaaccggaaaccgggttcttaacggttaaccgtttaagtttaacgtttacgggttggaccggggtaaggggaaacggggtaagtaacggttcggaactaaccgaacgaacccggg

SEQ ID NO: 322667 - DNA, 619 bp, Homo sapiens
  misc_feature: GZ8MTXP01AQ2TN.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggacggtccctgacgactctctgtgaagcctctggattcagcttcagttacgtatgggtttgcgtcgtgggtccgcgaggctccgaggcgaagggctgcgtaggtcgggtgcagtctagtatacagtataggaaaaggaacgaactaaagtaaatacgtacggcaaacgtaccgtaccggtaggaacgggtcctaattccgaaccctagtacctaccgaagacgaacaactacccaaagtaacctactaactttacacgttacgaacctaaaacgtctaaacccgacccgtaagtacggtaccttggaaacggtcgtaaacggttctacggttccttaagttagtttgggcgaccgggaagggaacggtgacttacggatccgaacgtaacg

SEQ ID NO: 322668 - DNA, 645 bp, Homo sapiens
  misc_feature: GZ8MTXP01DOKKZ.51.6.A06.1.454.CMB.2.raw
  modified_base (399)..(399): a, c, t, g, unknown or other
  misc_feature (399)..(399): n is a, c, g, or t
  modified_base (494)..(494): a, c, t, g, unknown or other
  misc_feature (494)..(494): n is a, c, g, or t
  modified_base (510)..(510): a, c, t, g, unknown or other
  misc_feature (510)..(510): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccagtccgtgggacgtccctgagactctcctggtgaacgcctcgtggattcagcttacagttacgttagttgggtttgccggtcgtcggggtcccgccgaggcctcccgaggacgtaaggggactggcgtagggtggggttgactatctatatactaagtagtaggaaaaaagggtaanaactaaaattaaaactaaccgtacgacaaggtaaaccgtccggtaggaacggggacctactaccacatacctaccaagacaacaactaccgaaanaacctactaactttanactactaacaaagtacgaaacctaacccgtagtaacgtacgttacggaacggaactacggttacgttacgttacttaagtttagttacggttggacggaagggaaggggtaacgacgacgactaaccgaacgtcg

SEQ ID NO: 322669 - DNA, 669 bp, Homo sapiens
  misc_feature: GZ8MTXP01CML2U.51.6.A06.1.454.CMB.2.raw
  modified_base (419)..(419): a, c, t, g, unknown or other
  misc_feature (419)..(419): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccaggccgtgggagtccctgagactctcctgtgagcctcgtggattcagcttcgagttacgtagttgggtttgccgcgttcggggcccgccgagggcctccccgaaggggcgaaagggggccttgggacgagggggttgggggtcggactagttaccttaaatacgttacgaaagttacgtaggaaaaaagggaaanaactaaaagttaaaactacctaacggactaacggaccgttaccggtaggaaacgggcctaatttaccaacctattaccgaccgaaagaacgaaccaaacgtaaccccaaaagtaaaccctaacgttaactttaagtacctagaactaaaagtccgaaacctacccgtagtaacgacgtaggacgtaacgacggcttagttctaaagttgttgttggacggaaggaagggaatatacgatccgaagaaccg

SEQ ID NO: 322670 - DNA, 624 bp, Homo sapiens
  misc_feature: GZ8MTXP01BSQHZ.51.6.A06.1.454.CMB.2.raw
  modified_base (367)..(367): a, c, t, g, unknown or other
  misc_feature (367)..(367): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggaggcgtggtccagccgtgggacgtccctgacgactctctgtgaacgcctctggattcagcttacagtacgtatggtttgcgtcgtgggtccgccgacggctcccgaggcgaagggactggctagggtggtggcatctatatcatatgaaaagaancaaataaactactaacgcaacgtactaccgtagaacgggccattcaacctatcctacagacgaacaactacccaaagaacaccgtaacttttacaccttagaactaaacgtacgaaacctaaccccgtaggtaaaccgtacctttggaaggtaaccctacgggttacttaccggttacttaaacgtttaggtttggttacggacgggtaagggtacggggaaggttaactacgggaacttaacccaaggtaacccgg

SEQ ID NO: 322671 - DNA, 668 bp, Homo sapiens
  misc_feature: GZ8MTXP01D5LIU.51.6.A06.1.454.CMB.2.raw
  modified_base (278)..(278): a, c, t, g, unknown or other
  misc_feature (278)..(278): n is a, c, g, or t
  modified_base (310)..(310): a, c, t, g, unknown or other
  misc_feature (310)..(310): n is a, c, g, or t
  modified_base (385)..(385): a, c, t, g, unknown or other
  misc_feature (385)..(385): n is a, c, g, or t
  modified_base (599)..(599): a, c, t, g, unknown or other
  misc_feature (599)..(599): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgttcttttaagaggtgtccagtgtcaggtgcagctggtgcaggtcgtgggggagcggtggtccagccgtggggacgtccctgagactctcctgtagaacgcctgtggattcagtctanagtacgttagtggtttgcgtcgtcgggtcccnccgaggcctaccggaggacgaagggctggcgtaggtggggtgactagtctatatcaagtagtaggaaaggaaaanactaaagttaaactaccgtaaaccgctaacggtacccgtaccgggtaaggaaaccggggtcccttaacttacccaacctattacccgtaacccgaaggaaccaaacctaaaccgtaaccccaaaagtaaaccctaaccttaaccgttttaagacttacgaaactaaagtccgaaacctacccgtaagacgtacgtagaacggtacaaccggttnttagttacttagttagtggaggacggttaaaggaaggtataacgtacgacttaccgaacgaacgaaccg

SEQ ID NO: 322672 - DNA, 497 bp, Homo sapiens
  misc_feature: GZ8MTXP01DH001.51.6.A06.1.454.CMB.2.raw
  modified_base (412)..(412): a, c, t, g, unknown or other
  misc_feature (412)..(412): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
  modified_base (469)..(469): a, c, t, g, unknown or other
  misc_feature (469)..(469): n is a, c, g, or t
  modified_base (482)..(482): a, c, t, g, unknown or other
  misc_feature (482)..(482): n is a, c, g, or t
  modified_base (489)..(489): a, c, t, g, unknown or other
  misc_feature (489)..(489): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggatcacctgctctggagatgcattcgacccaaacccacttattcttattggtaccagcagaagccaggccaggccctgtgttgtgatatataaagacactgagaggccttcgagggactcccgtgagcgtattctctcggctccacctcgagggaacaatggtacactattcgaccatcagtgagtccaggcagaagacgagctgactattcngtacaagtcttanagacatcagtgtactntgtctcgatggacaggtcacgtctagcngccaagccaaccnctgttcncttctccg

SEQ ID NO: 322673 - DNA, 570 bp, Homo sapiens
  misc_feature: GZ8MTXP01ECHUY.51.6.A06.1.454.CMB.2.raw
  modified_base (287)..(287): a, c, t, g, unknown or other
  misc_feature (287)..(287): n is a, c, g, or t
  modified_base (360)..(360): a, c, t, g, unknown or other
  misc_feature (360)..(360): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggaggcgtggtccagcctggggaggtccctgagactctcctgtgaagcctctggattcagcttcagtacgtatggttncgctcgggtccgccaggctccgaggcgaaagggctgcaggtgggtgcatctatatcaatataggaaaaggaancaaataaatacctacgacagactccgtagaggccgatcaccatctaccagacgacaactacccaaagaaccactaactttatactacgaacaaagtcgaaacctaaccccgtgaacgtacttacggaacggtaaccaacgggttcttacggttacttaagtttagttagttcggacgaagggtaagggaagtagtacgatcgaacgaacg

SEQ ID NO: 322674 - DNA, 595 bp, Homo sapiens
  misc_feature: GZ8MTXP01B6VIA.51.6.A06.1.454.CMB.2.raw
  modified_base (278)..(278): a, c, t, g, unknown or other
  misc_feature (278)..(278): n is a, c, g, or t
  modified_base (313)..(313): a, c, t, g, unknown or other
  misc_feature (313)..(313): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (448)..(448): a, c, t, g, unknown or other
  misc_feature (448)..(448): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcgagtcgtgggggaggcgtggtccaggccgtggggaggtccctgacgactctcctgtgaacgcctcgtggattcagcttnaggtacgtagttggtttgccgtcgtcggggtcccnccgaggcctccgaggcgaaagggctggcgagggtgggtgctatctatatcagtanaggaaaagancaaataaatcacncagactcgagacgcatcacatcacagacacaactaccaaagaacctacgtactttanctagaaccaaatccgaaacctacccgtagaacgtacttacggacggtaacctaacggttcttacggttacttaaagtttacgtttagggttcgggacggtaaggggaggggtaagtacgtaccggttaactaaccgaacgtaaccgg

SEQ ID NO: 322675 - DNA, 528 bp, Homo sapiens
  misc_feature: GZ8MTXP01EYIR6.51.6.A06.1.454.CMB.2.raw
  modified_base (353)..(353): a, c, t, g, unknown or other
  misc_feature (353)..(353): n is a, c, g, or t
  modified_base (405)..(405): a, c, t, g, unknown or other
  misc_feature (405)..(405): n is a, c, g, or t
  modified_base (494)..(494): a, c, t, g, unknown or other
  misc_feature (494)..(494): n is a, c, g, or t
  modified_base (522)..(522): a, c, t, g, unknown or other
  misc_feature (522)..(522): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgaagcctctggattcagcttcagtacgtatggtttacgcgtgggtccgcaggctcgaggcaagggctgcaggtgggtgcatctatactcaatagtagaaaggaaanacaagtaaactactaacgcaagactcgtagaagggccatcacatctacaganacaactcccaaagaacactactttatctagacaaatcgaaacacctagagtactgacggacaacgggcttggtacttattagttgaggngagggaagggataagtcggattcaacgngaaccg

SEQ ID NO: 322676 - DNA, 696 bp, Homo sapiens
  misc_feature: GZ8MTXP01BW4OC.51.6.A06.1.454.CMB.2.raw
  modified_base (173)..(173): a, c, t, g, unknown or other
  misc_feature (173)..(173): n is a, c, g, or t
  modified_base (309)..(309): a, c, t, g, unknown or other
  misc_feature (309)..(309): n is a, c, g, or t
  modified_base (518)..(518): a, c, t, g, unknown or other
  misc_feature (518)..(518): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagnggtgtccagtgtcaggtgcagctggtgcgaggtcgtgggggaggcgtggtccagccgtgggacgtccctgagactctctgtgacgcctctggattcagcttcagttacgtagttggtttgcgtcgtcggggtcccnccgacggctcccgaggacgaaggggtctggcgtagggtgggggtgcattcgtaatactcaatagaggaaaaaggaaacgctaaaagttaaactaccgtaaccgacaacggtaccgtcccgggtagggaaacgggtcccgtaacttccgaacctatacccgtaccaagaacgaacaaactacccgaaagtaaaccctacgtaacttttanacctacgaactaaactcgaaacctacccgtagtaaacggaacgtttcggaaacgggtaaccctaaccgggttacgttacggttaaccttaaacgttttaggttaacggttcgggaaacgggtaaagggaaggggtaacggtaattccgggttaaacttaacccggaaacgaacccggg

SEQ ID NO: 322677 - DNA, 601 bp, Homo sapiens
  misc_feature: GZ8MTXP01CHB6L.51.6.A06.1.454.CMB.2.raw
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagcccaccctcggtgtccgtcgtccccaggacaggacggccaggatcacctgctcgtggagatgcattcgacccaaaccctattatttcttagttcggtaccagcagaagccaggccaggcccctgtgttgtgatatataaaggacactgagagccttcgagggactcccgtgagcgacttctctcggcctcacctcgaggaacaagtgacacattacgaccatcaggtgacgtcgaaggcaagaaggacgagggctgacttactttctagtactaagttcttacgaagtacctagtacgtaggttagttaaccttgtgttaccgttacggtaaacggtcgggaaacgttacggttaccgacccggttacgtcggttaccgacgttaccccgaacggaccccaaaccccgtcgtccgttcctaaccgtttccgttaaccccg

SEQ ID NO: 322678 - DNA, 698 bp, Homo sapiens
  misc_feature: GZ8MTXP01EWBOS.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggactcacctgctctggagatgctattgacccaaacccacttatttcttaattggtaaccagacagaagccaggccacggcccctgtgttgtgatataataaagacactgagacggtccttcgaggtactcccgtgagcgtattctctcggcctccactcgagggaacaagtcggtcaactattacggacctagtcgaggttcggtacggtacccaggggacgaaggaaaggaaccggaagggtcttacggtaaacctttacgtttacgttacgtaactaacgtttactttacgaacgtaactacgttaccgtaggtttacgggtttaaacctttagtcgggtttacttaaccggggtaaacggttaacggggtaaacccgttaacggggttaccttaaccccgggttccgttaacgggttcccgaaccgggttaccccaaaccggggacccctaaaacccccggtacttaccggttccctaaccgtttcccttaaccccgg

SEQ ID NO: 322679 - DNA, 713 bp, Homo sapiens
  misc_feature: GZ8MTXP01CJVYL.51.6.A06.1.454.CMB.2.raw
  modified_base (415)..(415): a, c, t, g, unknown or other
  misc_feature (415)..(415): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccaggccgtggggacgtccctgacgtactcgtccgtggtgaacgtcctcgtggtattccagtcttacgtaggttacgttagttggtttcgcggtcgtcgggtccccgaccgaggcctccgaaggacgaacgggtctcggacgtagggtggggtcgactagtacttatactacgaatagtaaggaaaaaggaanaactaaaataaactaccgtacgacgaacggtaccgtaccggtaagggaacgggtacctacttaccaacctatacccgaaccgaacggaactaaaccaaaccttaacccgaaagtaaaccctaacgttaacttttaacacgtacgaaactaaacgtaccgtaaaccctacccgttagaacccgttaacgtacgggaaccgggtaaccgtacccgggttattacggttactttaaagtttcgttagggaggaccgggtaaggggtaacggaagtacgtacgaactaaccgaacgtaaccg

SEQ ID NO: 322680 - DNA, 681 bp, Homo sapiens
  misc_feature: GZ8MTXP01AD3Z3.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccagccgtgggacgtccctgagctctcctgtgacgcctcgtggattcagcttcgagttacgtagtggtttgcggtcgtcggggtccgccgaggcctccgaggcgaaggggctggcgagggtgggtgctagtctatatcaagtagtaggaaaaacgggaagaactaaaataaaacgtacctaaccggctaacggtacctaccggtaggaacggggaccctaacttaccgaaccctagtacccgtaccgaaaggtaacgaaacctaaaccgtaaccccgaaaacgtaaaccctaaaccgttacttttaactaccgttagaaacctaaaactacggaaaccctacccgtaggaaccgtacgttacggaaacggtaacgtaaacgggttccgttaggttacctttaaagttagttcggttaggacgggtaagggagggaagtacgtacggataaccgaacgaacg

SEQ ID NO: 322681 - DNA, 677 bp, Homo sapiens
  misc_feature: GZ8MTXP01AUWH7.51.6.A06.1.454.CMB.2.raw
  modified_base (378)..(378): a, c, t, g, unknown or other
  misc_feature (378)..(378): n is a, c, g, or t
  modified_base (512)..(512): a, c, t, g, unknown or other
  misc_feature (512)..(512): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtggggagtccctgagactctctgtgaacgcctctggattcagcttcagttacgtagtggtttgcgtcgtgggtccgccaggctccgaggcaaggggactgcgtaggtggggtgctagtctaatactacataagtacggaaaaagggaaacnctaaaataaaactacctaacggactaacggtaaacgtcccggtaagaaacgggtcccgtaacttccaaccattacctacccgaaggtaaccgaacaaaccgttacccaaacgtaaacctacgtaacttttaacnccgttaagacctaaaacgtcgaaacctacccgtacgacggtaaccgttgggaacggtaaccaacgggttccttagttaccgtttaagtttaacgtttggttcggttaccgggtaaggggtaacgggggaactaaggttaccggaacttaacgaaccggtaaccgg

SEQ ID NO: 322682 - DNA, 615 bp, Homo sapiens
  misc_feature: GZ8MTXP01B9NEM.51.6.A06.1.454.CMB.2.raw
  modified_base (304)..(304): a, c, t, g, unknown or other
  misc_feature (304)..(304): n is a, c, g, or t
  modified_base (352)..(352): a, c, t, g, unknown or other
  misc_feature (352)..(352): n is a, c, g, or t
  modified_base (497)..(497): a, c, t, g, unknown or other
  misc_feature (497)..(497): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccaggccgtgggacgtccctgagctctcctgtgaagcctctggattcagcttcagttacgtatgggtttgcgtcgtggggtcccnccgaggctcccgaggcaaggggctggcaggtgggtgcagtctagtatnatagtgaaaaggaagcaaataaatactaagcaacggctacgtagaacgggccgtattacacctatacctaccaagaacgaactaacaacccaaacgaaccacttaactttagtacctacgaactaaactacggaaccctaacccnggtaacgacgttacgggaacggtaaccgaacggttccgttgttaaccttaaagttttcggttggttcgacgggtaaggggaagggaagtacgttacggaactaaccgaacgaaccggg

SEQ ID NO: 322683 - DNA, 573 bp, Homo sapiens
  misc_feature: GZ8MTXP01CDO0F.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttggggtttttcctcgttgcttctttttaagaggtgtccagtgtcaggtgcagctggtgcaggtcgtgggggagcgtggtccagccgtgggagtccctgagactctcctgtgagcctctggattcagcttcagtacgtatggtttgcgtcgtgggtccgccgacggctccgaggcgaagggctgcaggtgggtgcatctatatcatatagaaaggaagcaaataaatactacgacacgtactcccggtaggaacgggacgtacttcaccgatcctaccagacgacaactacccaaagaaccactactttaactacctagacctaaatcgaaacacccctagtacgtacgtgaacggaacgacggttcgtagttcttaagtttgttcgttggcgggtaagtaggggaagtagtcgactcgaacgaaccgg

SEQ ID NO: 322684 - DNA, 715 bp, Homo sapiens
  misc_feature: GZ8MTXP01A3EUP.51.6.A06.1.454.CMB.2.raw
  modified_base (394)..(394): a, c, t, g, unknown or other
  misc_feature (394)..(394): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttcctcgttgctctttaagaggtgtccagtgtcaggtgcagctggtgcaggtcgtgggggagcgtggtccaggccgtggggacgtccctgacgtactctccgtgtagaacgtcctctggtacttcagcttacgagttacgtatggttgcgtcgtcgggtcccgccgtaggcctaccgagggaccgaaagggggtctggccgtagggtgggtgctagtctatatcaagtagtaggaaaagggaanctaaaagttaaactacgtaccgacgtaacggaccgttacccgggtagggaaacggggtccctaagttacccaacccgtaattacccgtaccgaaacggaacgaaacctaaaccgtaccccaaaagtaaacccaccgttaaacttttacaccgttacgaactaaaacgtaccgaaaccctaacccgtagtaaccgtacgttaacgggaccggtaaaccggtacccggttgttaaccttacggttaactttaacgtttaggggcgggaacgggtaagggtaacggggtaacgtaacgtacggttaaccgtaaccgaacgaacg

SEQ ID NO: 322685 - DNA, 755 bp, Homo sapiens
  misc_feature: GZ8MTXP01ALMZV.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcaggtcgtgggggaggcgtggtccagccgtgggacggtccctgagactctcctgtgacgcctcgtggattcagcttcagttacgtatggtttcgcgtcgttcgggtcccgccgaggcctcccgagggacgaaaggggtactggacgtagggtggggtcggctagttcctattactcaaagttaagtaggaaaaaagggaaacgtaactaaaattaaaacgtaccgtaaccgacgtaacggtaaccgttcccgggtaacgggaacggggacccgtaacttaccgaacctacttaccgtaccgaagaacgaacctaaaccgtaaccccgaaacgtaaacccaaccgttaactttttaacgtaccgttaacggtaaactaaaacgttaccgaaaccctaaccccggttagtaaaccggtaaccgttacgggaaacgggtaaccgtaacgggttacgtttacggttaaccttaaagttttaacggttagggttccgggacgggtaaggggtacggggtaaaggtacgttaccgggaacttaacccgaacggtaacccggg

SEQ ID NO: 322686 - DNA, 698 bp, Homo sapiens
  misc_feature: GZ8MTXP01DJ4PN.51.6.A06.1.454.CMB.2.raw
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcagggtgcagctggtgcgaggtcggtgggggaggcgtggtccagccgtgggacgtcctgagctctctgtgagcctngatcanctnagtacgtatggttgcgtgtcgggtcccncgaggcctccggaggacgaagggctggcgagggttgggngacagttcttaatatactaagtaagtaggaaaaaagggaaactaacgtaaaattaaaactaaccgtaccgacctaaggaacccgtcggtaggaaacgggtccgtacttaccgaacctagtacctacgaagaacgaaacaaacctaacccgaaagtaaacctaaccgttaacttttaactactaacgaaactaaaacgtaccgaaaccgttaaccccgtaggtaaacgtacgttaaacgggaacgggtaaacccgtaaccgggttactttacggttaccgtttaaagtttaacgttagggttcggaaccgggtaagggaacgggggtaaatacggtacgttacgtaaccgaacgtaacccgg

SEQ ID NO: 322687 - DNA, 545 bp, Homo sapiens
  misc_feature: GZ8MTXP01D0CL1.51.6.A06.1.454.CMB.2.raw
  modified_base (299)..(299): a, c, t, g, unknown or other
  misc_feature (299)..(299): n is a, c, g, or t
  modified_base (441)..(441): a, c, t, g, unknown or other
  misc_feature (441)..(441): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagactctcctgtgaagcctctggattcagcttcagttacgtagtggtttgcgtcgtgggccnccgaggcctccgaggcaagggctggcgaggtgggtgcagtctaatatcagtataggaaaagaagcaaataaatactacgacagactccgtagaaggccatcacatcacagacgacaactacccaaagaaccactaactttanacgtagaaccaaatcgaaacctacccgtgaacgtactaggacggaacacggctagttactagttattgttggacgtaaggagggaatacgtgatcgaacgaacg

SEQ ID NO: 322688 - DNA, 713 bp, Homo sapiens
  misc_feature: GZ8MTXP01EXDB7.51.6.A06.1.454.CMB.2.raw
  modified_base (330)..(330): a, c, t, g, unknown or other
  misc_feature (330)..(330): n is a, c, g, or t
  modified_base (371)..(371): a, c, t, g, unknown or other
  misc_feature (371)..(371): n is a, c, g, or t
  modified_base (414)..(414): a, c, t, g, unknown or other
  misc_feature (414)..(414): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggtttttcctcgttgtcttcttttaagaggtgtccagtgtcaggtgcagctggtgcaggtcggtgggggaggcgtggtccaggccgtggggacggtccctgacgtacttctcctggtgaacgccctcgtggtattcagtcttacgaggttacgtagttgggtttgccggtcgtcggggtcccnccgaggcctccgaggacgaagggggctggcgtagggtgggngactattactagtatacaagtaagtaggaaaaaagggtaaacncctaaaaaattaaaccgtacgtaccgacgtaaacgggtaccgttaccgggagggaaaccggggccctaacttcccaaccctagttaccacccgaaaggaacaaccaaactaaccccaaaagtaaaccccaacgttaaactttacacctacgaacctaaaacgtccgtaaaccacccgtagtaacgtaacgtacgggaacggtaacgtacgggttcttacggttaccttaaagttaagttggttcgggaacgggtaagggaagggtaagtaacgtcccggaaactaaccgttaacgaacg

SEQ ID NO: 322689 - DNA, 620 bp, Homo sapiens
  misc_feature: GZ8MTXP01BX2EF.51.6.A06.1.454.CMB.2.raw
  modified_base (306)..(306): a, c, t, g, unknown or other
  misc_feature (306)..(306): n is a, c, g, or t
  modified_base (599)..(599): a, c, t, g, unknown or other
  misc_feature (599)..(599): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggactcacctgctcgtggagatgcattcgacccaaccctattattcttattggtaccagcagagccaggccaggccctgtgttgttgatatataaagacactgagnggtccttcgaggactcccgtgacgcgtactttccctccgtaggtccctcccgacccgtacgacgggaactaaagtcgggtacactagttacgacctatccgaggtcgggacgtccgaaggcgaaggaaacgacggaggctagacttatttctagggtactaagtcttacgagactagtccgtaggttcgttaacttagttcgttccgttaacgggaacgttcgggaacccttaaggtcccgtaacccgttaccgttcggttaccgaacgtaccccgaacggaccccaaccccncgttaaccgttcttaaccccg

SEQ ID NO: 322690 - DNA, 598 bp, Homo sapiens
  misc_feature: GZ8MTXP01BLRKT.51.6.A06.1.454.CMB.2.raw
  modified_base (368)..(368): a, c, t, g, unknown or other
  misc_feature (368)..(368): n is a, c, g, or t
  modified_base (475)..(475): a, c, t, g, unknown or other
  misc_feature (475)..(475): n is a, c, g, or t
tcagcgatcgtatacacgaccggtgctcgatttagatctactgacaggggtctgggagacgagcccagcactggaagtcgccggtgtttccattcggtgattttcatcactgaacacagaggactcaccatggagtttgggctgagcttgggttttcctcgttgcttcttttaagaggtgtccagtgtcaggtgcagctggtgcagtcgtgggggagcgtggtccagccgtgggacgtccctgagactctcctgtgacgcctctggattcagcttcagttacgtagtggtttgcgtcgtgggtcccgccaggcctccgaggcaaggggctgcgaggtgggtgcatctatatcagtatggaaaaggaancaaataaactacgtacgcaagacgtaccggtagaacggggccctaattccgaacctataccctaccaagacgaacaaactaccccgaaagaaaccactaacttttanactacgaacaaagtcgaaaccacccgttgaacgtacgttggaacggaactacgggttcttaggttcttattaagttcggttgacggtaaggaggggtaacagtaccggataaccgaacgaacg

SEQ ID NO: 322691 - DNA, 824 bp, Homo sapiens
  misc_feature: GZ8MTXP01AITR3.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgaggtcgtgggggaggcgtggtccagccgtgggacgtccctgacgtactctcctgtgaacgccctgtggtattcagtcttacgaggttacgttagttgggtttcgccggtcggttcggggtccccgccgaggccctaccgagggacgaaagggggtcctggaccgtagggtcgggggttagcctaagttaccttaatacgtactaaagttaaaggtaggaaaaaaaagggaaacgtaacctaaaaaagtttaaaaaccttaaccgtaaccggaccgtaaacggtaaccccgttacccgggtaaggggaaacggggtccccttaaagtttaccccgaaaccctacgtttaccccgtaaccgaaaggaaacccgaaacctaaaacccttaacccccggaaaaagtaaaccccttaaaccgttaactttttaaaccaccgtaaacggtaaaccaaaaacgttccgaaaaccctaaccccggtaggtaaaccgttaaccgttagggaaccgggtaaaccgaccgggttacgttaacggttacttaaagtttacgttagggttcggttaacgggaaggggtaacggggtaagtaaccgtacgggttactaaccgaacggtaacccggg

SEQ ID NO: 322692 - DNA, 661 bp, Homo sapiens
  misc_feature: GZ8MTXP01EG8WP.51.6.A06.1.454.CMB.2.raw
  modified_base (391)..(391): a, c, t, g, unknown or other
  misc_feature (391)..(391): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtgggacggtccctgacgactctcctgtgaagcctctggattcagcttcagttacgtagttggtttgcgtcgtcggggtcccgccgaggcctaccgagggacgaaagggggtactgggacgagggtggggtgactatctatactcaagtataggaaaagggaacnctaaataaactactacgacaaggacgttaccggtaggaacgggtacccgtattaccaacctattacccgtaccaagaacgaacaacctaaccccaaagaacctactaactttatacctagacaaactacgaaaccctaccctagtaacgtaacgtttggaacggaaccgtaacggttccgttaggtttacttaaagtttagtttagggttcggttacgggaagggtaagggggaaccgtaggtacggaacttaacccggaaacgtaaccg

SEQ ID NO: 322693 - DNA, 734 bp, Homo sapiens
  misc_feature: GZ8MTXP01D16YI.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgctattgaccaaacctattattccttattggtacccagcagaagccaggccaggcccctgtgttgtgatataataaagacactagagagccttcgagggactcccgtgagcgtattctctcggcttccaccgtcgacgggaaactaaagtggtacaactatttacggaacctacttacgaggttacggacgttacccggaaggaccgaaaggaaacggtaacggaacggggtcttaacgggtaactttaactttcgttacggttactaaagtttaccgtttaacaaacggtaacctaattaccgtaagggtttacgggttaaaccttttaagttacggtttacccgttaacggggtaaaccgttcgggggtaaaccccgttaaaggggtaccccgttaaacccggttaccggtaacggggttcccaaacccggttaaccccgtaaacccggggtacccccaaaaccccccggtaactcccggttaccctaacccggtttaacccgtttaaccccccg

SEQ ID NO: 322694 - DNA, 698 bp, Homo sapiens
  misc_feature: GZ8MTXP01ADLEF.51.6.A06.1.454.CMB.2.raw
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctctatgtgctgacacagccacccgtggtgtccgtcgtccccaggacagaccggccaggatccacctgctcgtggagatgctattcgaccccaaacctactttatttacttaagttcggtaacccagacaagaacgccgacggccgacggtccctgtgttgttagataataataaagactacgtggagtacggcctttacgagggtactcccgagtacgcgtacttctcgtccggtcctaccaccgtcgaacgggtaaactaagttcggtacaaaccgtacgtttaccgaacctacgtacgtaagggttacgggtacgtacccggaagggaccaaagggaaacgggtaacggagggtacttacggaactttacggtttactacgttactaacgtttactacgtaacgtaactaacgttaccgtagttacggttaacttacggtcgttacggttaccgggtaacgttcggggaacttacggtccaccggttacgtacggttacgaccggacccgaaccggtcccaaacccgcttacgcctaaccgttccgttccccg

SEQ ID NO: 322695 - DNA, 592 bp, Homo sapiens
  misc_feature: GZ8MTXP01A4VSC.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccagccgtgggacggtccctgacgactctcctgtgaacgcctctggattcagcttcagttacgtatggtttgcgcgtgggtcccgccgaggcctccgaggcaaagggctgcgaggtgggtgctatctatatcatataggaaaagaagcaaataaactactacgacaaggactccggtagaacggccgtattcgaccatacctaccaagacgaacaaactacccaaagaaccacgtaactttacactagaactaaactacgaaacctacccgtagtaacgtaccgttaggaacggaacgacggttcctgttacttaattagttggttcgacggaaggtaggggaatacgtacggttatccgaacgtaaccg

SEQ ID NO: 322696 - DNA, 674 bp, Homo sapiens
  misc_feature: GZ8MTXP01B2VQO.51.6.A06.1.454.CMB.2.raw
  modified_base (349)..(349): a, c, t, g, unknown or other
  misc_feature (349)..(349): n is a, c, g, or t
  modified_base (630)..(630): a, c, t, g, unknown or other
  misc_feature (630)..(630): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcaggtcgtgggggaggcgtggtccagccgtgggacgtccctgacgctctcctggtgaacgcctcgtggattcagcttcagttacgtatgggtttgcgtcgtcgggtcccgccgacggctccgaggacgaaggggactggcgaggtggggnggcagtctatatacaagtagtaggaaaaggtaaagcctaaaagtaaaactaaccgtacgaccgtaaggtaaccgtacccgggttagggaaacggggtaccgtaacttaccaaccctaacttacccgtaccgaagaacgaaccaaacgtaaccccaaaagtaaaccctacctaaacttttaactacctaggtaacctaaaactaccggaaacctaaaccccgttagaaacggtacttacgggaacggtaacgacgggttctacggttattacttagttcggnggacggtaaggaggggtaacagtacgttactaacgaacgaaccg

SEQ ID NO: 322697 - DNA, 659 bp, Homo sapiens
  misc_feature: GZ8MTXP01BKRQK.51.6.A06.1.454.CMB.2.raw
  modified_base (293)..(293): a, c, t, g, unknown or other
  misc_feature (293)..(293): n is a, c, g, or t
  modified_base (358)..(358): a, c, t, g, unknown or other
  misc_feature (358)..(358): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgaagcctctggattcagcttcagtacgtatggttgcgctgggccncaggctccaggcaagggctgcgaggtgggtgcattctatatcgaatagtaggaaaaaagggaaanaactaaaataaacgtacgtaacgacgaacgtaccgtaccggtaggaaacgggacctaactaccgaacctacttaccgtaccgaaagaacaaaccaaacgtaacccaaaacgtaacctaacgttaaacttttaacgtaccttaacgaaacgtaaacgtaacgtaaaccgtaacccgtaacgtaacgtaacgtaacggtaacggaacgtaacggttacgttacgttacgttaacgttaacgttacggttacggttacgggaagggtaagggtaaggtaacgtacgttacgtaacgaacgaacg

SEQ ID NO: 322698 - DNA, 798 bp, Homo sapiens
  misc_feature: GZ8MTXP01DR57Q.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtcccgtgtcccccaggacagacggccaggactcacctgctcgtggagatgctattcgacccaaaccctacttattcttattcggtaaccagcagacgccaggccacggccctgtgttgtgatatataaagcactgagaggtccttcgagggtactcccgtggacgtcgtattctacgtcggcctaccgaccgtacgaacggggaaacctaaagttcgggtacaaacgtacgttacggaacctacgttacggagggttacgggtaacggttacccgaaggggaaccgtaaagggaaaacggtaaccggggtacgggtaccgttacgggttaaaccgtttaacttttaccgttacggttaaccttaaactttcccgtttaaccggaaagttaacccttaacggttaacgttaacgggttttacggtttaaaccgttttacgtttaccggtttaaccggtttaaccgggtaaaaccgggttaaccgggggtaaaacccgtttaaacgggttaccccgttaacccggggttacccgttaacgggttacccgaacccggttaccccgaaaccgggtacccccgtaaacccctacggttaccgttacccttaacggtttaacccctttccccg

SEQ ID NO: 322699 - DNA, 737 bp, Homo sapiens
  misc_feature: GZ8MTXP01EV6KV.51.6.A06.1.454.CMB.2.raw
  modified_base (252)..(252): a, c, t, g, unknown or other
  misc_feature (252)..(252): n is a, c, g, or t
  modified_base (312)..(312): a, c, t, g, unknown or other
  misc_feature (312)..(312): n is a, c, g, or t
  modified_base (715)..(715): a, c, t, g, unknown or other
  misc_feature (715)..(715): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgagtcgtgggggagcgtgtccagccgtgggacggtcctgacgactctctgngaacgcctgtggtattcagcttagagttacgtagttggtttcgcggtcgtcggggtcccnccgacggcctaccgaggacgaaacgggggtctgggcgtagggtggggtcgactagttactaattactactaagttaagtaagggaaaaaaggaaacgtaacctaaaaaatttaaaacgtaaccgtaaccgaccgtaaacgggtacccgtttacccgggtaagggaaacccggggtacccgtaaacgtttacccaaacccgtacttacccctaacccgaaaggaaaccgaaacctaaaaccttaacccccgaaaaacgtaaacccttaaaccgttaacttttttaaacacctacgaaactaaaactaccggaaaccctaacccgtagaaaccgttacgtacggaacggtaaccgtaacggttcttagttaccgttaagttgttaggttcggacggaaggaaggngtatacgactaacgaacgaacg

SEQ ID NO: 322700 - DNA, 588 bp, Homo sapiens
  misc_feature: GZ8MTXP01APD0Y.51.6.A06.1.454.CMB.2.raw
  modified_base (380)..(380): a, c, t, g, unknown or other
  misc_feature (380)..(380): n is a, c, g, or t
  modified_base (565)..(565): a, c, t, g, unknown or other
  misc_feature (565)..(565): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtggggggaggcgtggtccagccgtgggaggtccctgagactctcctgtgaagcctctggattcagcttcagttacgtatgggtttgcgtctggggtccgccaggcctccaggcaagggactgcaggtgggtggcatctatatcatatagaaaaggaagcaaagtaaatactacgnagactccgtagaaggccgagttcaccatacctccagtacgaaccaactacccaaacgaaccaacgtaactttaataccttacgaacctaaacgttacgaaaccctacccgttagaacggtaccgttaggaacggaacacgggcttcggttaccttattaagttgttggacggtaaggaagggaanacggttacgagttcaacgtaacg

SEQ ID NO: 322701 - DNA, 588 bp, Homo sapiens
  misc_feature: GZ8MTXP01AU9E8.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgacggcctcctatgtgctgacacacgcccacccgtcggtgtccgtcgtccccaggacagacggccaggactcacctgctctggagatgcattcgacccaaaccctacttattcttagttggtaccagcaagaacgccaggccacggccctgtgttgtgataatataaacgaccactgagacggccttacgacgggctcccgtggacgtcgtactttctcgtcggccctcccaccgtcgagggactaagtcggtacactattcgaccagttacgaaggtcggggtacgccgaaggccgaaggaacggacgacgggtctagtacttactttctgtaacaaacttctacagtaactagttcgttaggttggttaacttgtcgttcgttacgggacgttaacgggaaccgtaaccggg

SEQ ID NO: 322702 - DNA, 549 bp, Homo sapiens
  misc_feature: GZ8MTXP01C8OCS.51.6.A06.1.454.CMB.2.raw
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
  modified_base (350)..(350): a, c, t, g, unknown or other
  misc_feature (350)..(350): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtncagctggtgcagtcgtgggggagcgtggtccagccgtgggattcccngagactctctgtgaacgcctctggattcaactcagtacgttatggtttgcgtcgtcgggtccgccaggcctccgaggacgaaagggctgcgtaggtgggtgcatctaatanacatagtaggaaaggaaaagactaataaatactacgacagactcgagaggccatcacntcacaganacaacaccaanaacactattacngtacacaaatcgaactacctagactacgttaggacgacgaacgtcttggtacttagttaagttggacgcggaaaggtggggaaatcgtacgacttacaacgaacgaaccg

SEQ ID NO: 322703 - DNA, 693 bp, Homo sapiens
  misc_feature: GZ8MTXP01DH5DP.51.6.A06.1.454.CMB.2.raw
  modified_base (325)..(325): a, c, t, g, unknown or other
  misc_feature (325)..(325): n is a, c, g, or t
  modified_base (491)..(491): a, c, t, g, unknown or other
  misc_feature (491)..(491): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtcccccaggacagacggccaggatcacctgctctggagatgcattcgaccaaaccctattattcttaattcggtaccagcagagccaggccaggcccctgtgttgtgatataataaagcactgagagtccttgagggacttcccgngacgtcgtattctcgtcggcctccgacctcgaaggggaaacctaagtcgggtacaaccgtattacggaaccctagttcgaggttgggacgttacccggaggacgaaaggaaacggaacggacgggtcgtaggtaacttacgtttctagttacctaagtttccttanaacgtatagttcctaaggttcgttaactttagttcggtttaccgttacggggtaaaccgttaacggggtaaacccgttaacgggttacccgttaaaccggttaccgttacgggttaacccgaccggaaccccggaaaccgggaaccccctaaccccggtaacccttccggttacccttaaccctttccggtttaaccccccg

SEQ ID NO: 322704 - DNA, 649 bp, Homo sapiens
  misc_feature: GZ8MTXP01AU5KX.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgcattcgacccaaacctattacttcttattcggtaacccagcaagaagccaggccacggccctgtgttgtgatataataaagacactgagacggccttacgaggactcccgtagacgtcgtattcgtcgtcggcctaccaccgtcgagggaaactaagtcggtacactattcgaacctagtacgaggtacggacgtaccgacgggaccgaaggaaacggaaccggtagggtactacggtaaccttatttccgtagttaccctaaagtttcctttaacgaacgtaactacttaccgtaggttacggttaactttagtcgtttacgttaccggaacgttcgggaaacccgttaggtacccgttaccgtaccgtaggttaccgcggacccgaaccgaccccaaccgtacttcgaccctaaccttccgttccccg

SEQ ID NO: 322705 - DNA, 647 bp, Homo sapiens
  misc_feature: GZ8MTXP01CWZ0X.51.6.A06.1.454.CMB.2.raw
  modified_base (215)..(215): a, c, t, g, unknown or other
  misc_feature (215)..(215): n is a, c, g, or t
  modified_base (322)..(322): a, c, t, g, unknown or other
  misc_feature (322)..(322): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattcgacccaacccattattcttagttggtaccagcagaagccaggccacggccctgtgttgttgatatataaagacactgagacgtcttacgaggactccgngacgcgtattctctccggcctccacgtacgagggaactaagtcggtacactattacgacctatacgaggtggacgtaccgaagggaccaaggaacggacggagggtacttacggtaacttacgtttactacgttaacctaaactttccgttaccggaacgtaaccctagttaccgtaaggttggtttaaccttagtcgttacgttacgggtaacgtaacgggtaaacttacggtccacccggttacgtacggttccgaaccggaccccgtaaaccggacccctaaccccgtacgttccgttaccctaaccgttccgtttcccccg

SEQ ID NO: 322706 - DNA, 694 bp, Homo sapiens
  misc_feature: GZ8MTXP01E5FN9.51.6.A06.1.454.CMB.2.raw
  modified_base (316)..(316): a, c, t, g, unknown or other
  misc_feature (316)..(316): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccaggccgtgggacggtccctgacgactctccgtgtgaacgcctcgtggacttcagcttcgagttacgtattggtttcgccgtcgtcgggtccnccgaggtcctccgaagggacgaaacgggggtactgggcgaaggggttcggggtacgacctattccgtaattactcaaagtaagtaaggaaaaaaacgggaactaacctaaaattaaactaccgtacgacgtaacgtacccgtacccgggtaggaaacgggtccctaacttacccaacctaagttcccaaccgaagaaaccgtaaccaaacgtaaccccaaataaacccaccgttaactttacaccgtacaaactaaacgtacgaaaccctaccgtagaacgtactacggaacggaaccgtacggttactacgttacttaagtttaagttgggttcgacgggaagggacggggaataacgtcgaactaaccaacgaacg

SEQ ID NO: 322707 - DNA, 544 bp, Homo sapiens
  misc_feature: GZ8MTXP01DFFN8.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaacccactattcttattggtaccagcagagccaggccaggcccctgtgttgtgatatataaagacactgagaggccttcagggactccctgagcgtattctctcggcctcactcagggaacaatggtcacattgaccatcagtgagtccaggcagaagacgaggctgacttatttctagttaccaaagttcttcaagtactatcgagttggttaactttagtgttacgttcggaactgggaaccaagggttccaaccggttcctagggttccacggccccaacggacccaaccccatcgttcctaacgttcctttcccg

SEQ ID NO: 322708 - DNA, 686 bp, Homo sapiens
  misc_feature: GZ8MTXP01AUYN5.51.6.A06.1.454.CMB.2.raw
  modified_base (648)..(648): a, c, t, g, unknown or other
  misc_feature (648)..(648): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggagcgtgtccagccgtgggacgtccctgacgactctctgtgacgcctcgtggattcagtcttacgaggttacgttagttcgggtttcgccggtccggttcggggtccccgccgacggtccctaccggaagggaccgtaaacgggggtactgggaccggtagggggttcggggtacggactaagtccttaagtactactaagtaagtaggaaaaaaggacgtaacaaaagttaaactaacctacgacacggtactaccgggtagggaaacgggcctaacttaccgaacctatacccgtacgaaagaacgtaaccaaacctacccgaaagtaaaccctaacgttaacttttacacctaaggtaaacaaactacgaaccctacctaggtacgtacgtacggaacggtaaccaccggttgtcgttactaaagttcgttcggngcgggaagtagggaacaaggtcactcaacgtaacccgg

SEQ ID NO: 322709 - DNA, 682 bp, Homo sapiens
  misc_feature: GZ8MTXP01AE48B.51.6.A06.1.454.CMB.2.raw
  modified_base (219)..(219): a, c, t, g, unknown or other
  misc_feature (219)..(219): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtcgtccccaggacaggacggccaggatcacctgctcgtgganatgctattcgacccaaacctacttatttcttagttcggaccagacaagaacgccaggccacggtcccctgtgttgttagattataataaagacacgtggaaggacggtcctttacggagggtacttcccgtaggaggtccgtattccgttcgtccggccctaccaccgtacggaacgggaaactagtcggtacaacgtattacgacctagtcgaggtggtacgtccggaaggacgaaagggaagacgggaggtacgtacggtaactttacgtttcgtacgtactaacgtttctacgaacgtaacctacgttacgtacggttagtttaactttagttccgttacgttaccgggtaacggtcgggtaaccgttaacgggtcccttacccggttacgtaacggttcgaccgaccccgaaccggtaccccaacccgtcgtcgttaccctaaccgttccgttcccccg

SEQ ID NO: 322710 - DNA, 748 bp, Homo sapiens
  misc_feature: GZ8MTXP01CRS8Q.51.6.A06.1.454.CMB.2.raw
  modified_base (219)..(219): a, c, t, g, unknown or other
  misc_feature (219)..(219): n is a, c, g, or t
tcagcgatcgtatacacgaccggtgctcgatttagatctactgacaggggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggactcacctgctcgtggganatgcattcgacccaaaccctattattcttattcggtaccagcaagaacgccaggccacggccccttgtgttgttagattaataataaagacacgtaggagtacggtccttacgaggggtacttcccgtaggacgtccggtaatttccgtaccgttccgggacccttacccgaaccgttacggaacgggggtaaacctaaaggttcgggtacctaaaccggtatttaccggaacctagttaccgaagggttcgggtaacgtacccggaagggacgaaaggaaacggaacgggtacgggtacttacgggtaactttagttttactacggttaccttaaacgtttccgtttaaccgaaggtaacctaagttaccgtaggtttacggtttaacctttaagttccggttacgttacgggaaaccgttcgggaaaccgttacgggtcccaccggttaccgtacgggttacccgacgaccccgaaacgggaccccctaaacccgtcgtcgttaccctaacccttcgtttaaccccg

SEQ ID NO: 322711 - DNA, 664 bp, Homo sapiens
  misc_feature: GZ8MTXP01D21WJ.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtcccgtgtccccaggacagacggccaggatcacctgctctggagatgcattcgacccaaaccctacttattcttaattcggtaccagcagaagccaggccaggcccctgtgttgtgatatataaaagcactgagaggccttcgagggactccctgagcgtattctctcggcctaccacctcgacgggaaactaagtcggtacactagttacgacctagtcgaaggttggacgtacccgagggacaagggaaacgaaccggaagggtcctaggaacctttaatttccgtaggttaccctaaagtttcctttaacgaagtaaccctattaccgtaaggtttcgggttaaactttagttcggttacgttaccgggtaacgttaacggggaacccgttaagggttcccttaaccggttccgtaacggttccgaccggaccccgaaacgggtaccccaaaccccgtcgtacgttacctaaccgtttcctttccccg

SEQ ID NO: 322712 - DNA, 623 bp, Homo sapiens
  misc_feature: GZ8MTXP01CHA6B.51.6.A06.1.454.CMB.2.raw
tcagcgatcgtatacacgaccggtgctcgatttagatctactgacagggggtgggtccaggaggcagaactctgggtgtctcaccatggcctggatcccctctacttcctccccctcctcactctctgcacaggctctgagtcctcctatgtgctgacacagccaccctcggtgtccgtgtccccaggacagacggccaggatcacctgctctggagatgcattgcccaaacccatattcttattggtaccagcagaacgccaggccgaggcccctgtgtgttgatataataaagacactagagacggccttgagggactcccgtgacgtcgtattctcgtccggtcctaccgtaccgtcgaagggaaccaaagtcgggtacctaaacgtattacgaacctaactacgtaagggtcggtaacgtacccgaagggaccgaaaggaaacggaacggaacgggtctacggtaacttaactttccgtagttacttaaacgtcttacaagtacatactagtaggttacgttagtgttcgtacgtaacgtaacggtaacgaacgtacgaccgtaccgtacgttcgcgaccgaaccgacccaacccactacgttactaaccgttctcccg

SEQ ID NO: 322713 - DNA, 666 bp, Homo sapiens
  misc_feature: GZ8MTXP01EYOV8.51.6.A06.1.454.CMB.2.raw
  modified_base (650)..(650): a, c, t, g, unknown or other
  misc_feature (650)..(650): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtggggggagcgtggtccgagccgtgggtacgtcctgacgtactctcgtgtagacgtcctgtggtactcagtcttacgagttacgtagttggttcggccgtcggttccggggtcccacgtacggccgtaccggaggacggaacgggtctgggcgtagggtggggtcactatactaatactacagtaagagggaaaaaagtaaacaactaaaaagtaaactacccgtaacgacgtaaacgtaccggttacccgggaagggtaaaccgggtcctaaacttacccaacctactttaaccccgagaaacggaacaaactaaacccaaaccgaaaaactacctaacgttaacgtttaacacgaacaaataaaccacgaaccctacgtagaccgtagtaggacgaactcggttgttcttagtaattgttggcggagaagggaggtaatcncgataacgaacgaacg

SEQ ID NO: 322714 - DNA, 846 bp, Homo sapiens
  misc_feature: GZ8MTXP01CV451.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccaggccgtggggacggtccctgacgtctcgtcctggtgaacgcctcgtggattcagcttcgaagttacgttagttggtttcggccgtcgttcggggtacccgcccgtaacggcctccgaaggccgaaacgggggtacctgggaccggtagggttgggggttacgggaccaagttccgttaaacttaagttactaagtaagtaacggaaaaaagggaaagtaacctaaaagttaaaaacttaaaccgtaaaccgacgtaaacggtaaacccgtaccccgggttagggtaaaacccgggggaccccgtaaacgttttacccgaaaacccccgttaactttaccccggtaaacccaaacgggtaaaaccgtaaaccccgtaaaaaacttacccccccgaaaaaggtaaaaccccgtaaaccgtttaaacccccgttttttaaagtaacccctttagggtaaaacccaaaaacggttaaccgaaaacccctaaaccccgtagtaaaccggttaacccgttagggaacggtaacccgacgggttacctttaggttacccgtttaagttaagttggttccgacggtaaggacgggtaagaacgttacgttacgtaaccaacggtaaccg

SEQ ID NO: 322715 - DNA, 665 bp, Homo sapiens
  misc_feature: GZ8MTXP01APAVF.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggagcgtggtccagccgtgggacgtccctgagtactctccgtgtcgaagcctctgggattcgagtcttacgagttacgttagtgggttttgccggtcgttgggtccccgccaggcctccgaggcgaaagggctgcgtaggtggggtgcagtctatatcagtaatggaaaaaggaagaactaaataaatactacgacaaggactacccggtagaacgggaccgagttaccacctattaccaccagaacgaaccaactaacccaaacgtaaaccacttaactttaataccgtaagaacctaaaactcgaaaccctaacccgtagtaaccgtacgttcggaaacgggaaccgtaaccggttcgttacgttaccgtttaacgttaagttttcgggacggaaccgggttaaggggagggtaaacgtacgttacgggaacttccccgaagtaaacccggg

SEQ ID NO: 322716 - DNA, 767 bp, Homo sapiens
  misc_feature: GZ8MTXP01BU1B0.51.6.A06.1.454.CMB.2.raw
  modified_base (712)..(712): a, c, t, g, unknown or other
  misc_feature (712)..(712): n is a, c, g, or t
  modified_base (719)..(719): a, c, t, g, unknown or other
  misc_feature (719)..(719): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagcgtggtgcgaggtcgtgggggaggcgtggtccaggccgtgggacggtccctgacgactctcctgtcgaacgtcctcgtggtattcagtcttcgagttacgtagttcgggtttcgccggtcgtacgggtcccgccgacggtccctccggaagggacgaaacgggggtctcggcggtaaggggttggggtcggactaattccgttaaattacgttacgaaagttacgtaaggggaaaaaaacgggtaaacgtaacctaaaaaagtttaaaaccgttaccgtaaccgggtacgtaaacgggtacccgttacccgggttaggggaaaccgggtaccccgttaattacccgaacctaacgttaccctaccgaaagaaccgaaacctaaaacctaccccgaaaagtaaccctaaaccggttaacttttaacgacctaaagaacctaaacgtacgaaaccctaacccgtagtaacggtaccttacggaacggaaccgtacgttaccgttatttacgtaagtttnttcgggnggttaccggaagggtaggaacgtacgtacgattaaccgaacgtaacgg

SEQ ID NO: 322717 - DNA, 693 bp, Homo sapiens
  misc_feature: GZ8MTXP01EVX60.51.6.A06.1.454.CMB.2.raw
  modified_base (278)..(278): a, c, t, g, unknown or other
  misc_feature (278)..(278): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggaccagacggccaggatcacctgctctggagatgcattcgacccaacccattattcttatacggtaccagcagaagccagccagcccctgtntgttacgaatacacgacacgtgacgtcgacgtacacggtacgacgtcgagtcgacttcgtctcgccgtacccgtacgtaccgaaggtacgtaaaactacgggtaactacacgttacgtaccagtcgtacgtacggtacgtaccgaacggaacgaacggaacgacggtaggtactacgtacttagttccttaagtacctacttaacggggtactaacgtaccgtacgttacgtacgttacggttacgtttacgttacgggtacccgttaacgggtaccggtaacggtaacccgtaaaccgttccgtaacccgttaccgtacccgtaacccggaccgaacccccgaacccgaacccctaacccggttaacccgttaccgtacccttacccgtttcccccgttcccgttttccccccg

SEQ ID NO: 322718 - DNA, 698 bp, Homo sapiens
  misc_feature: GZ8MTXP01A5XVP.51.6.A06.1.454.CMB.2.raw
  modified_base (531)..(531): a, c, t, g, unknown or other
  misc_feature (531)..(531): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggagcgtggtccaggccgtgggacgtccctgacgtactctcctgtagaacgcctcgtggattcagcttacaggttacgtagttgggtttcgcgtcgtcggggtcccgccgaggcctcccgagggacgaacgggggtactggacgtagggtggggtcgctagtcttaatacgtcaagttaagaggaaaaaagggaagaactaaaattaaaactacgtaacgctaacggaccgttacggtaggaaacggggtaccctaattacccaacctattacccaccgaagaacgaaccaacgtaccaaagaaacctactaactttaanactaacgaactaaactacgaaacctacccgtagtaacgtacgttacggaacgggtaacctaacgggttctttacggttacctttaagtttaacggtttcgggttcggttaaacggggaagggtacgggggaaatacggtacggttaactaacccgaaggtaacccgg

SEQ ID NO: 322719 - DNA, 760 bp, Homo sapiens
  misc_feature: GZ8MTXP01AW15X.51.6.A06.1.454.CMB.2.raw
  modified_base (309)..(309): a, c, t, g, unknown or other
  misc_feature (309)..(309): n is a, c, g, or t
  modified_base (738)..(738): a, c, t, g, unknown or other
  misc_feature (738)..(738): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagctggtgcgagtcgtgggggagcgtggtccagccgtgggacgtccctgagactctcctgtgacgtcctctggattcagcttacgagttacgtagtggttgcgtcgtcgggtcccnccgaggcctacgaggcgaaaggggtctggcgtagggtgggtcgactattcgtaactacgtacaagtaagtaggaaaaagggaaacgaactaaaagttaaaacgtcccgttaaacgacgtaaacggtaaccgttaacccggggtagggtaaaacggggtcccctaatttaccccgaaacccttaaacgtttacccgaacccgaaaggaacccgaaaaccaaacccgttaaacccccgaaaagttaaaccctaaaccgtttaacttttaacgtaccttaaaccggaaactaaaaaccgttccgaaaaacccctaaccgtaacgtaacggtaaccgttaacgggaacgggaaccgttaaacggttccgtttagttaaccgtttaaagtttacgttcgggttaggaccggttaaagggacgggtaagttaccnggttaactccgaacgtaacccg

SEQ ID NO: 322720 - DNA, 779 bp, Homo sapiens
  misc_feature: GZ8MTXP01B4WAD.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatccacctgctctggagatgcattcgacccaacccattattcttattcggtaccagcagaagccaggccaggccctgtgttgttgatataataaagacacgtgagacggtccttagagggacttcccgtagagcgtattccgtcgtcggccctaccgacccgtacgaacggggtaacaacgttcgggtactaaccgtagttttaccggaaccctaaggttacccgtaagggtttacggggaacggttaccccggaaggggaccgaaaagggaaaacgggttaacccgggaagggtacccgttaaggtaacccttttagttttaccgttaggttaccttaaaacgtttcctttaaccgaacggtaaccctaagtttacccgtaaggtttcgggtttaaacctttttaagttcgggtttaccgtttaccggggaaaccggttaacgggggtaaacccgttaaaccggggtttacccttacccgggttaaccccggtttaacggacccgttaaccgacccccgtaaaccggaccccctaaaccccgtaacgtccgttaccgtaaccctttcgtttcccccgg

SEQ ID NO: 322721 - DNA, 653 bp, Homo sapiens
  misc_feature: GZ8MTXP01ATL8U.51.6.A06.1.454.CMB.2.raw
  modified_base (217)..(217): a, c, t, g, unknown or other
  misc_feature (217)..(217): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggactcacctgctcgtgganatgctattcgacccaaccctattactttcttattcggtaaccagcagaacgccgacggccacggccctgtgttgtgatataataaagacactggagaggtccttgaggactcccgtgacgcgtattcgtctcggcctaccgacgtacgaggaaacaagtcggtacacgtattacgacctagtcgtaaggtcggaacgtaccgaggacgaaaggaaagggacgaggtacctaggtaactttagttcgtagttactaaacgttcttaactacgactattcgaagtttcggttaacctttagtcgttaccgtttacggaacggttaacgggtaaccttaagggttcccaccggttccgtaacgggttccaaccggttaaccccggaacccggacccctaacccgtacgtccgttacctaaccgttcccgtttaaccccc

SEQ ID NO: 322722 - DNA, 579 bp, Homo sapiens
  misc_feature: GZ8MTXP01CD40G.51.6.A06.1.454.CMB.2.raw
  modified_base (343)..(343): a, c, t, g, unknown or other
  misc_feature (343)..(343): n is a, c, g, or t
  modified_base (506)..(506): a, c, t, g, unknown or other
  misc_feature (506)..(506): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatcctctacttctcccctctcactctctgcacaggctctgaggcctctatgtgctgacacagccacctggtcgtccgtgtccccaaggacaggacgccaggactcacctgctcgtggagatgcattcgaccaaccactattctattgtaccagcagaacgccacggcacggccctgtgttgtagatatataagacactgagagtccctaanagggaactcccgtgagtcgtattctcgtcggtccctaccgaccgtcgaacgggacctaaagtcggttacaacgtacttacgaacctattaccgaggttacggggacgtaccgaaggacgaagaagaccggagctagacttagttcagtcctaattccgttaanacgactacttacgttacgttagttaacgttacgttaacgttacgtacggttacggtaacggttaacggtaacg

SEQ ID NO: 322723 - DNA, 678 bp, Homo sapiens
  misc_feature: GZ8MTXP01EARLM.51.6.A06.1.454.CMB.2.raw
  modified_base (401)..(401): a, c, t, g, unknown or other
  misc_feature (401)..(401): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgaggtcgtgggggaggcgtggtccaggccgtgggacggtccctgagtactctctgtgaacgcctctggattcagcttcagttacgtagtgggtttgcgtcgtcgggtcccgccgtacggctccgaaggcgaagggggacttggcgagggtgggggtcggactatactaagtactacgaataagtacggaaaaaagggaanaactaaaataaaacgtaactacgacaagtacgtaccgtaggaacgggtccgtaattccaactactaccgtacccgaagaacgaacaaactaccccaaaagaacctaacgtaaccttttaatacctacgtaaactaaaactacgtaaaccgaaccccgtagtaacgtaaccgttcgggaaacggtaaccgaacgggttctacggttactttacgttaggtttacgttggaacggtaagggaaggggtaagtaaccgtggaaacttcgaacgtaaccgg

SEQ ID NO: 322724 - DNA, 665 bp, Homo sapiens
  misc_feature: GZ8MTXP01ADGE4.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgctattcgacccaaaccctacttattcttagttcggtacccagcaagaacgccgaggccacggtccctgtgttgtgtaatataataaagactactggagacggtacctttacgagggacttcccgtaggacgtcgtattcctcgtccgcctccgaacctcgaacgggaactaagtcggtacactagttacgacctatcgagtggtacgtacccgagggacgaaggaaaggacggacggtaccgttagtaaccttatttcgttacgtaactaaacgttctttaacgagtaacctagtacgtaggttacgttaaccttagttacggttaccgtaacggacgttaacggggaaaccttaacgggttccgaacccggttacgtacggttcgaaccggttacccgaaccggacccctaacccgcgtacgttcctaaccgttccgtttccccg

SEQ ID NO: 322725 - DNA, 637 bp, Homo sapiens
  misc_feature: GZ8MTXP01ECIIP.51.6.A06.1.454.CMB.2.raw
  modified_base (258)..(258): a, c, t, g, unknown or other
  misc_feature (258)..(258): n is a, c, g, or t
  modified_base (597)..(597): a, c, t, g, unknown or other
  misc_feature (597)..(597): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctcctatgtgctgacacacgcccacccgtcggtgtccgtgtcccccaggacagaccggccaggatcacctgctcgtgganatgcattcgacccaaccctattattcttaattggtaccagacaagaacgccaggcccacggtccccttgtgttgttagaatataataaacgacctacgtgaagacggtccttaacgaagggtctcccgtaggacgtcgtacttctcgtcggccttaccgacctacgacgggaacctaaagttcggtactaactagttacgaaccctataccgtaaggtcggggtacgttacccgaagggacaaaggaacggacggtagggaccttaggtaactttactttcgtccgtaataaattcctttacaaggtacctaagttccgttaggttacggttaaacttntcggtttcgtacggttactaacggggaaccttaaaccggg

SEQ ID NO: 322726 - DNA, 603 bp, Homo sapiens
  misc_feature: GZ8MTXP01EBTM3.51.6.A06.1.454.CMB.2.raw
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (472)..(472): a, c, t, g, unknown or other
  misc_feature (472)..(472): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtcagccgtgggacgtcctgagactctctgtgaagcctctggattcagcttcagttacgtagtggtttgccgtcgtcgggtcccgcgaggcctaccgaggacaaggggactgcgaggtgggtgctatctatatacagtanacgaaaaggaanaacaaataaaacttacacgacaagtacgtaccgtaggaaggtcctataccacctattaccacaaggaacaacaaactaccaaagtaaccaacttaactttanactacgaacctaaaagcgaaaccaacccgtagaacgtacgttaggaggaaactcggttcttacgtttagtaatttacgttaggcgacggaagggaaaggggttaacgacgtacgttactaacgaaccgaag

SEQ ID NO: 322727 - DNA, 641 bp, Homo sapiens
  misc_feature: GZ8MTXP01A3PDX.51.6.A06.1.454.CMB.2.raw
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatgggagtttgggctgagtcttggggttttcctcgttgcttcttttaagaggtgtccagtatcaggtgcagctggtgcaggtcgtgggggagcgtggtccagccgtgggaggtcccngagctctctgtgancctntggattcagctnagtacgtnttggttgcgcgtcgggcccncgaggcctaccgaaggcgaaagggggtctggaccgtagggtgggtagactagttacctatatcaattanaggaaaaggaancaaaataaataccgtacgacaggacctccggtagaaacgggccaattccaacctatacctaccgaagtaacgaacctaactaaccccgaaaagaaccctaactaactttaacttccaacgaactaaaagtcgaaaacctaccgtagaaccggtaacttcgggaacggaacgaaccgggttcttacgttaacgttaagtttaagttcggttacggacgggtaagggagggtaactacgtacgttactaacgaacggaacg

SEQ ID NO: 322728 - DNA, 622 bp, Homo sapiens
  misc_feature: GZ8MTXP01C36YU.51.6.A06.1.454.CMB.2.raw
  modified_base (262)..(262): a, c, t, g, unknown or other
  misc_feature (262)..(262): n is a, c, g, or t
  modified_base (563)..(563): a, c, t, g, unknown or other
  misc_feature (563)..(563): n is a, c, g, or t
tcagcgatcgtatacacgaccggtgctcgatttagatctactgacagggcacgaccggtgctcgatttagatctactgacagggggctgtgggtccaggaggcagaactctgggtgtctcactatggcctggatccctctacttctccccctctcactctctgcacaggctctgacggcctctatgtgctgaccacacgcccaccgttcggtcgtccgtcgtccccgaggaccaggaccgccaggactcacctgctctggantgcattcgacccaacctactatttcttattaggtaccagacagaagccgaggtcccgacggtccccgttgttcgttgttgacttaagtataaagacccctacgtagagacgtcccttaacgacggtctcccgtgaacgtcgtacttctcgtcggtcctaccaccgtcgaagggtacctaaagtcggtacctacgtattcgaacctatcgaaggtcggggacgttaccgaggacgaagaaacggtaccggaggtaccttaggtaacttactttcgtgtaactaacttcttaccgagtaactnttacgttagttcgggttaattagtcgttcgtacgggttaactcgggaaccttaaccggg

SEQ ID NO: 322729 - DNA, 721 bp, Homo sapiens
  misc_feature: GZ8MTXP01CPI0S.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggagcgtggtccagccgtgggagtccctgagactctcctgtgaacgcctctggattcagcttcagttacgtagttggtttcgcggcgtgggtcccgccgaggcctccgagggcgaaaggggactggcgagggtgggtcggcagttctaattacgtcaatagtaggaaaagggtaacgcaaaataaaacgtactacgacaaggacctaccggtaggaacggggtaccctagttaccaacctaactacctaccgaacgaacgaaacccaaacttaaccccgaaaagtaaaaccctacttaacttttaaactaccttacggaaacctaaaacgttacgaaaccctaaccccgtagtaacggtaaccgttacgggaacgggtaaaccgtaccgggttacgtttacggttaccgtttaaacgttttcgggttaggttcggggaaaccggggtaaggggtaacggggggtaaatacgggtttaacgggaccttaaccgttaaacccggtaaccggg

SEQ ID NO: 322730 - DNA, 554 bp, Homo sapiens
  misc_feature: GZ8MTXP01E2DJT.51.6.A06.1.454.CMB.2.raw
  modified_base (116)..(116): a, c, t, g, unknown or other
  misc_feature (116)..(116): n is a, c, g, or t
  modified_base (240)..(240): a, c, t, g, unknown or other
  misc_feature (240)..(240): n is a, c, g, or t
  modified_base (287)..(287): a, c, t, g, unknown or other
  misc_feature (287)..(287): n is a, c, g, or t
  modified_base (475)..(475): a, c, t, g, unknown or other
  misc_feature (475)..(475): n is a, c, g, or t
  modified_base (488)..(488): a, c, t, g, unknown or other
  misc_feature (488)..(488): n is a, c, g, or t
tcagcgatcgtatacacgaccggtgctcgatttagatctactgacagggcacgaccggtgctcgatttagatctactgacagggggctgtgggtccaggaggcagaactctgggtntctcaccatggcctggactccctctacttcctccccctctcactctctgcacaggctctgaggcctcctatgtgctgacacagccacctggtcgtccgtcgcccaggacagacgcagatcactnctgtggagatcgacattcgaccaaaccctatattctagttcggacanacaagaacgcacggccacggtccctgttgttgtagaataataataaacgaccactagaacgacgtccttaagacgggtaactccgtgagctattctcgtacggcctaccgacttacgagggaacagttacggacactatacgaaccatacgaggtgggacgaccgaaggacaaaggaacgagttaggntatattacttctntaactacttacttaacagatattagttgttagtaatatgtcgtacgttacgtaacggaacgtaacg

SEQ ID NO: 322731 - DNA, 753 bp, Homo sapiens
  misc_feature: GZ8MTXP01BNG9Y.51.6.A06.1.454.CMB.2.raw
  modified_base (669)..(669): a, c, t, g, unknown or other
  misc_feature (669)..(669): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgaggtcggtgggggaggcgtggtccaggccgtggggacgtccctgacgtactctcgtgtcgaacgcctcgtggaattcgagtcttcgaagttacggttagttgggttttcgccggtcgttcggggtccccgtacccgacggtccttaccccggaaggggaccgtaaagggggtaccttcgggcggtaagggggttggggtcggactagttaccttaacgtacttcaagttaagtagggaaaaaaagggtaaacaactaaaaattaaaacgtaccgtacgactaaggtacccgtacgggtacggaacgggtacctacttaccaaaccgtacttaccccgacaaacgggaccaaaacccaaaccttaaccccgaaaacgtaaacccctaacgttaaacttttacgtaccttaacgaacctaaaatccgaaaccctacccggtagtaaccgtacgttagaacggtaaaccncgggttacttacggttactttaagttacgttagttcggacggtaaggaggggtaataacgtaggttactaacccgaagtaaccg

SEQ ID NO: 322732 - DNA, 641 bp, Homo sapiens
  misc_feature: GZ8MTXP01A6JLN.51.6.A06.1.454.CMB.2.raw
  modified_base (319)..(319): a, c, t, g, unknown or other
  misc_feature (319)..(319): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccacctcggtgtccgtgtccccaggacagacggccaggatcacctgctctggagatgcattcgaccctaaaccattattcttattggtaccagcagagccaggccaggccctgtgttgtgatatataaagacactgagagccttgagggtctcccgtgancgtattctactcggcctcacctacgacgggaaacaagtggacatacgttcgaaccatacgaggttagacgtacccagggacgaacggaaacgacggacgggtactacggtaacttagttccttagttactaaacgttcttacgaagactaacgtttcgaacgtttggttaacctttaggtcgttaccggttttacggaacggtcggggtaaaccccgttaagggttcccaccggttaccgtaaggggttacccaaccgggacccgtaaaccgggcccctaaacccgtaccgtcggttaccctaactttcccggttaaccccg

SEQ ID NO: 322733 - DNA, 688 bp, Homo sapiens
  misc_feature: GZ8MTXP01BM6Z5.51.6.A06.1.454.CMB.2.raw
  modified_base (215)..(215): a, c, t, g, unknown or other
  misc_feature (215)..(215): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggactcacctgctctgganatgcattcgacccaaaccctattattcttattcggtaccagcagaacgccaggccacggccctgtgttgtgatataataaagacatgagaggtccttacgaggtactccgtgacgcgtattctcgtcggcctcacgtcgagggaactaagtcggtacaactacttacgaccctaattcgaaggttgggactaccgaggacgaaaggaagtaaccggaggtactaggtaaccgttaatttctacgttaactaaacgtttccgtttaacgaaacgtaaccgttaattaccgtaaggtttacgggtttaaacctttaagttcggttaaccgtttaccgggtaaaccggtttaacggggaaacccgttaacggggttacccaacccgggtttaccgttaacggttaccgaccgggacccctaaaccgggaccccaacccctacggtacgttaccctaacccggttcctttcccccgg

SEQ ID NO: 322734 - DNA, 710 bp, Homo sapiens
  misc_feature: GZ8MTXP01D4DFL.51.6.A06.1.454.CMB.2.raw
  modified_base (279)..(279): a, c, t, g, unknown or other
  misc_feature (279)..(279): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggtttttcctcgttgcttcttttaagaggtgtccagtgtcaggtgcagctggtgcgagtcgtgggggaggcgtggtccgagccgtgggacggtccctgacgctctctgtgaacgcctactggattcagcttnagttacgtattggttgcggctgggtccgccgaggcctccgaaggcgaagggctgcgtaggtgggggttcggctagtcttaagtacttacgaattaagtacggaaaaggtaaagaactaaaataaactaaaccgtacgtacaacggtaccgttaccggttaggaaacggggaccgtaacttaccacctactaccgttacccgaagaacgaaccaaacgtaccccaaaagaaacctaacttaacttttactaaccgttacgaactaaaacgttacggaaacccaaacccgttacggtaaacgtaccgtttacgggaaacggaacccgtaacgggttaccgtaggtttaaccgtttaatttaaggtttaggttcgggttaaccgggaagggaaggggtaacggtaagtacgggaactaaccgaacgtaaccggg

SEQ ID NO: 322735 - DNA, 603 bp, Homo sapiens
  misc_feature: GZ8MTXP01CWZNK.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaaccctattattcttaattcggtaccagcagaagccaggccaggccctgtgttgttgatatataaagacactgagacgcttcgaggactcccgtgagcgtattctcgtcggcctaccgactcgagggaaactaagtggtacaactattacgaccactacgagtggacgtccgaggacgaggaagacggaggctagtaacttagttctagtactaagttcttacgacgtactactgtagttaggttaacttagttcgttacgttacgggtaacgtaagggtaaaccgaaggttcccaaccggttccgtaacggttaccgttacggcccgaaacggaccccaaccctacgtcgttacctaaccgttcctttccccg

SEQ ID NO: 322736 - DNA, 638 bp, Homo sapiens
  misc_feature: GZ8MTXP01CBFHH.51.6.A06.1.454.CMB.2.raw
  modified_base (633)..(633): a, c, t, g, unknown or other
  misc_feature (633)..(633): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccaggccgtgggacgtccctgagactctcctggtcgaacgcctcgtggattcagcttacgagttacgtagttggttcgcgtcgtcgggtcccgccgacggcctccgaggacgaaacggggctggcgtagggtgggtgctatctaactatcaagttagaggaaaagaagtaactaaaataaaacgtaccgtaacgactaacggtaccgtaccgggtacggaaacggggtaccctaacttcccgaaccgtactacctaacccgaagaacgaacaaacctacccaaagtaaccctaacgtactttaatacctacgaacctaaataccgaaacctacccgtgtaacgtaccttaggacggtaacacgggttctagttctagttgttggttcgaggaagaggaatacgcgataaccgngaacg

SEQ ID NO: 322737 - DNA, 760 bp, Homo sapiens
  misc_feature: GZ8MTXP01DPLN0.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgaggtcgtgggggaggcgtggtccagccgtgggacgtccctgacgtacctctccgtgtcgaacgccttcgtggtacttcaggtccttacgagttacgttagtgggtttcgccggtcgtcggggtccccgccgtacggtccctacccggaagggaccgaaagggggtcctcggacggtaggggttgggggtcggactacgtacctaagtactaacgtaagttaacgtaagggaaaaaacggaaagtaacgaaaaattaaaacgtaccgtaaccgacgtaacggtacccgtacgggtaacgggaacggtacccgtacttaccaacctaactacctaccgaagaacgaaccaaaacaccccaaaagaaccctaacgttaacgtttaactacgttacgaaactaaactaccgtaaacctaacccgttaagaaccggttaaacgttacgggaaacgtaaccgtacggttactttacgttaccgtttaaagtttggttaaggttccggttaagggaaagggtaagggaagttaacggacgttaacggttaaccaacgtaaaccgg

SEQ ID NO: 322738 - DNA, 640 bp, Homo sapiens
  misc_feature: GZ8MTXP01CGGFU.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccagcctgggagtccctgagctctctgtgaagcctctggattcagcttcagtacgtatggtttgcgtcgtgggtccgccgaggcctccgaggcaagggggactggcgaggtgggtgcatctatatcatatgaaaagagcaaataaactactacgcaagactacgagaacgggccgtattaccacctaagtcctacgagaacgaacaaactaccccaaagaacccaacttaactttaacgtctacgaaactaaacgtacgaaaccgtaacccctaggtaacgtaacccgttagggaaaccggaaccgtaccgggttcgttaacggttacgtttaaacgtttagtttacgggttggttaccggggaagggttaaacgggggaagaacggttaccggaacgttaacccgaacgtaaacccggg

SEQ ID NO: 322739 - DNA, 667 bp, Homo sapiens
  misc_feature: GZ8MTXP01AWAYP.51.6.A06.1.454.CMB.2.raw
  modified_base (307)..(307): a, c, t, g, unknown or other
  misc_feature (307)..(307): n is a, c, g, or t
  modified_base (380)..(380): a, c, t, g, unknown or other
  misc_feature (380)..(380): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggacgtccctgagactctcctgtgaacgcctctggattcagcttcgagttacgtagtggtttcgcgcgttcggggtcccnccgaggcctccgaggacgaagggggcctggcgtagggtgggtgcatctaatatcaatagtaggaaaagggaanaacctaaaataaactacgtaacgacgtaacggaccgttcccgggtaggaaacggggccctaaattacccaacctaataccctacccgaaggaacaaaccaaactaccccaaaagtaaacccacgttaactttatacctagaacctaaatccgaaacctacccgtagaacgtacgttacggaacgggaactaacgggttcttacggttacctttaagttagttcgggttcggacgggtaagggaacgggggaactaacggttaccggttaacgtaaccgaacggaacg

SEQ ID NO: 322740 - DNA, 630 bp, Homo sapiens
  misc_feature: GZ8MTXP01BIPB5.51.6.A06.1.454.CMB.2.raw
  modified_base (403)..(403): a, c, t, g, unknown or other
  misc_feature (403)..(403): n is a, c, g, or t
  modified_base (600)..(600): a, c, t, g, unknown or other
  misc_feature (600)..(600): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggagcgtggtccagccgtgggacgtccctgacgactctccgtgtgacgcctcgtggacttcagcttacgaggttacgtagttgggtttgccgtcgtcggggtaccccgccgaggcctaccgagggacgaaacggggctggcgtagggtgggtggactagttctaactactacaagtaagtaggaaaaacggaanaactaaaataaaactaccgtacgacaacggtactacccggtagggaacgggcctaattccacctactaccgtaccaaggaacaaccaaactacccaaagaaccactaactttagactagaacctaaagtcgaaacctacccgtagaacgtacgttaggaacgtaaccgaacggttcttggttaccttagttagttgngacgaaggagggaatagcgactcaacgaag

SEQ ID NO: 322741 - DNA, 700 bp, Homo sapiens
  misc_feature: GZ8MTXP01AL331.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctcccccctctcactctctgcacaggctctgacggcctcctatgtgctgacacacgcccacccgtcggtcgtccgtcgtccccaggaccagaccggcaggactcacctgctcgtggagatgctacttcgaccctaaccctatttactttacttagtttcggaacccagcaacgaacgacccgacggcccctacggtcccctggtttcgtttagtagtaattagtaaataaacgccctaacggtggaacggtaccggtccgttaaacggacgggtccttacccgtagggtacgtaccgtttacttccgtcgttcccggacccttacccgaacccgttcgggaacgggtaaccaacggttcggtaaccacttacgttaccggaaccttactacggtaaggtacggggtacgtaccggaacgggacgaaacggacggacggacggtaccttaaggttacctttatttcgtacgtaactaactttcctaccgagtacctacgttgttagttcgttaacttgtaaccggtcgttacgggacgttccgggaacctaacggg

SEQ ID NO: 322742 - DNA, 675 bp, Homo sapiens
  misc_feature: GZ8MTXP01BMTS9.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccagccgtgggaggtccctgagactctcctgtgaacgcctcgtggacttcagcttcagttacgtagtggtttgcggtcgttggggtcccgccgaggcctacccgaggcgaaagggggctggcgaggtgggtgcatcgtaatatcatagtaggaaaagggaagaacaaataaacgtactaacgacaacggaccgtcccgtaggaaacggggcctaattaccaccacgtaccctaccgaagaacgaaccaaactaccccaaaagaacctacgtaacttttactacccgtagaaaccctaaagtacggaaacccctaaccccgttaggaacgtaaccgttacggaacggtaacccgtaacgggttccttaggttaccttaaagtttacgttacggttgggttaccggaagggtaaagggggtaataacggttcccggaatcccggaaacgtaaccggg

SEQ ID NO: 322743 - DNA, 623 bp, Homo sapiens
  misc_feature: GZ8MTXP01ETCHG.51.6.A06.1.454.CMB.2.raw
  modified_base (452)..(452): a, c, t, g, unknown or other
  misc_feature (452)..(452): n is a, c, g, or t
tcagcgatcgtatacacgaccggtgctcgatttagatctactgacagggggtgggtccaggaggcagaactctgggtgtctcaccatggcctggatccctctacttctcccccctcctcactctctgcacaggctctgaggcctcctatgtgctgacacagccaccctcggtgtccgtgtccccaggacagacggccaggatcacctgctctggagatgcattcgcccaaccctactatttcttattcggtaccagcagaagccaggccacggcccctgtgttgttgatatataaagcactgagaggccttcgagggctcccgtgagcgtattctctcggcctccacctcgagggaaacaagtggtcactattacgacctatcgtaggtcggagtcccgaagggcaaggaacggacggaggactagtacttatttcctgtacaagttcttanaacgacatcgtgttaggttacttagtcgtttccgttacggtaacgttaacggggaaccgttacgggttacccgttacccggttaccgttaacgggttccgaaccggttaccccgaacgggaccccctaaaccccgtacgttacgttacctaaccctttccgtttaaccccg

SEQ ID NO: 322744 - DNA, 629 bp, Homo sapiens
  misc_feature: GZ8MTXP01CICJI.51.6.A06.1.454.CMB.2.raw
  modified_base (306)..(306): a, c, t, g, unknown or other
  misc_feature (306)..(306): n is a, c, g, or t
  modified_base (496)..(496): a, c, t, g, unknown or other
  misc_feature (496)..(496): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggagcgtggtccagccgtgggacgtccctgagctctctgtgagcctctggattcagcttacagttacgtagttggtttcgcgtcgtcgggtcccnccgaggcctccgaggcaaggggctggcgagggtgggtgctattctatatcgaagttagtaaggaaaagggaaataacgaaaattaaaactacgtacgacaaggtaccgtcggtaggaacgggtcctaagttaccacctagtcctaccgaagtaaccgaacaactacccaaagaacctaactaactttacnctaacgaactaaactacgaaacctacccgtagaacgtacgttacggaacggtaaaccgtacggttcttagttacttaagtttgttcggttcggacggaaggagggtaacgacgttacgatcccgaacgaacgg

SEQ ID NO: 322745 - DNA, 613 bp, Homo sapiens
  misc_feature: GZ8MTXP01EHSR2.51.6.A06.1.454.CMB.2.raw
  modified_base (173)..(173): a, c, t, g, unknown or other
  misc_feature (173)..(173): n is a, c, g, or t
  modified_base (316)..(316): a, c, t, g, unknown or other
  misc_feature (316)..(316): n is a, c, g, or t
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (504)..(504): a, c, t, g, unknown or other
  misc_feature (504)..(504): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagnggtgtccagtgtcaggtgcagctggtgcaggtcgtgggggagcagtggtccaggccgtggggacgtccctgacgactctcctgtagaacgtcctgtggattcagtcttcagttacgtgttggtttgccgtcgtcggggtcccnccgaggcctacgagggcaaggggctggcgaggttgggngntagtcctaatatnaatagtaagaaaggtaagactaaaagtaaactaccgtaacgctaacggtacctacgtaaggaacgggcctaattaccaccgtaattccacgaagaacaacctaaactacccaaaagtacctaacttactttaacnctaagaaccaatacgaaacctcctaggaactcgtagggaacgtacgacggtcttagtcttaagttgttggacggtaagtagggaagggactagttcgaacgttcgaacg

SEQ ID NO: 322746 - DNA, 639 bp, Homo sapiens
  misc_feature: GZ8MTXP01DLCC3.51.6.A06.1.454.CMB.2.raw
  modified_base (372)..(372): a, c, t, g, unknown or other
  misc_feature (372)..(372): n is a, c, g, or t
  modified_base (459)..(459): a, c, t, g, unknown or other
  misc_feature (459)..(459): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggaggcgtggtccagccgtgggaggtccctgagactctcctgtgaagcctctggattcagcttcagtacgtattggttgcgcgtcgggtcccgccgaggcctccgaggcaagggactggcaggtgggtgcagtctaatagtcaagtataggaaaacgggaancaaaattaaatacctacgacaggacctccggtaggaaacgggcctaacttacacctatacctaccgagaacgacaactacccgaaanaacctacgtaactttacacttacgaactaaaacgtcgaaaccaaccccgttagaacgtaacgttacggaacggaacctaacgggttccttaggttacctttaagtttaacgttcggttcggttacgggaaggggtaacggggtaagtaacgttaccggaacttaaccgaacgaacccggg

SEQ ID NO: 322747 - DNA, 734 bp, Homo sapiens
  misc_feature: GZ8MTXP01DUUP7.51.6.A06.1.454.CMB.2.raw
  modified_base (222)..(222): a, c, t, g, unknown or other
  misc_feature (222)..(222): n is a, c, g, or t
  modified_base (287)..(287): a, c, t, g, unknown or other
  misc_feature (287)..(287): n is a, c, g, or t
  modified_base (329)..(329): a, c, t, g, unknown or other
  misc_feature (329)..(329): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtcccgtgtccccaggacaggacggccaggatccactgctctggagntgcattcgacccaacctacttattcttagtcggtaccagacagagccaggccagccctgtgtgtnatatataaagcacgtagagacggtccttaggaggtactccgngaacgtcgtactttccgtacgtcggaccctcccgtaacccgtaacggaacgggtaacgtaaacgttcgggtaaccctaaccgttaagtttaccgggaaccctagttacccgtaagggttacgggaacggttccccggaaagggaccgtaaaaggggaaacggtaaccgggagggtacccttaaggtaacccttttaagtttccctaggggtaactttaactccgtttaacaacggtactagttacgtaggtttacgttaccttttagccgtttacggttaaccggaacggttagggtaacccgttaaacgggtccctaaccggttccggttaaacggttcccgtaacccggtaaccccgaacgggaaccccctaaccccgttacggttccgttcccttaaccccg

SEQ ID NO: 322748 - DNA, 658 bp, Homo sapiens
  misc_feature: GZ8MTXP01A2VKX.51.6.A06.1.454.CMB.2.raw
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
  modified_base (376)..(376): a, c, t, g, unknown or other
  misc_feature (376)..(376): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggacggtccctgagactctcctgtgacgcctctggattcagcttcagttacgtatggtttgcgtcgtgggtccnccaggctccgaggcgaagggactggcgagggttgggnggtacagtcttaatagtcaatagtagaaaacgggaanctaaaataaactacgtacgacaacgaccgttccggtaggaacgggcctaaattccaacctatcccttaccgaagaacgaactaaactaccccgaaagtaaaccacttaactttacgtactacgaacaaacgttacgaaaaccctacccgttagaacgtacgttacggaaggggtaacctaacgggttcctttagggttaccgtttaaacttttacgggttacgttgggaccggaaagggttaggggaagtacgttacgggaaacttccccgaaagaacccgg

SEQ ID NO: 322749 - DNA, 641 bp, Homo sapiens
  misc_feature: GZ8MTXP01CGLC9.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaaacccacttattcttattgggtaccagcagaagccaggccaggcccctgtgttgttgatatataaagacactgagaggcctttacgagggactccccgagacgacttacttcctcggtccgtccctacctccgtacgggacgaaactaggtcgactattagtaccgactacgtacgtacgggtacggtaccgtacggacgagaacggaacggaacgggtcgtagttacgtaactttcttacgtcgtaacttacttactagacgtaactctaggttagttacgtttattgttcgttacggtaccggtaagggtaaccggtaacgttacgaacgacggttaccgtaccggttacgacgacccgaaccggacccgaaccccgaccctcggttacctaaccttcccgtttaaccccg

SEQ ID NO: 322750 - DNA, 619 bp, Homo sapiens
  misc_feature: GZ8MTXP01ACHGV.51.6.A06.1.454.CMB.2.raw
  modified_base (478)..(478): a, c, t, g, unknown or other
  misc_feature (478)..(478): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaaccctattattcttattcggtaccagcagagccaggccaggccctgtgttgtgtataatataaagactactagagacggtccttcgagggcttcccgtggagcgtacttctcgtccggtcctccgacctcgagggaacaagtcggtacaactacttacggacctatcgtaaggtcggtacgtaccgaggacgaaggaaggacggaggtctaggtacttacttcgtagtacctaactttcgtaacgtanacctaagttaccgaggttacgttaccgttattcgttacgttacggacgttaacgggaccttaacggtccttaccggtacgtacgggttccgacgacccgaaccggcccaaccctcgtcgttactaacccgttcgttccccg

SEQ ID NO: 322751 - DNA, 592 bp, Homo sapiens
  misc_feature: GZ8MTXP01DW5PO.51.6.A06.1.454.CMB.2.raw
  modified_base (373)..(373): a, c, t, g, unknown or other
  misc_feature (373)..(373): n is a, c, g, or t
  modified_base (463)..(463): a, c, t, g, unknown or other
  misc_feature (463)..(463): n is a, c, g, or t
  modified_base (482)..(482): a, c, t, g, unknown or other
  misc_feature (482)..(482): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggtttttcctcgttgcttcttttaagaggtgtccagtgtcaggtgcagctggtgcagtcgtgggggaggcgtggtccagccgtgggaggtccctgagactctctgtgaagcctctggattcagcttacagttacgtattggtttgcgcgtgggtcccgccgaggctccgagggcaaggggctggcaggtggggtgcattctatatcaatataggaaaaacgggaancaaaattaaaacaccgtacgacaaggtaaccttccggtaggaaacggggcccaattcccaacatctacaaggaacacaaactacccaaanaaaccctacgtactttaancctagtaccaaaagtcaaaccaaaccctggaaacgtacgttagaacgggaactacggcttagttacttaattgttgttggagtaaggagggaacatcgatccaacgaacg

SEQ ID NO: 322752 - DNA, 611 bp, Homo sapiens
  misc_feature: GZ8MTXP01EXQHU.51.6.A06.1.454.CMB.2.raw
  modified_base (262)..(262): a, c, t, g, unknown or other
  misc_feature (262)..(262): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccaggccgtgggacgtccctgagactctctgtagaaacctntggattcagctcagtacgtagtggtttgcgcgtcgggtcccgcaggtcctccgaggcgaaaggggactggcgaggtgggggtgcatctatactcaatagtaggaaggaaagacaagtaaactacgtacgacagtaccgtacggtagaacgggtctaagttaccaccgtatcctaaccaaggaacaactaaatccccaaagaaacctacctaacgtttaatcccgtagaccaaaagttccgaaacctccgttaagaccgtacgttaggaacggactaacgggtcttgtacttagttaacgtgggttacgttagagggaaggtagtgtacgattacgtaacgcggaacccg

SEQ ID NO: 322753 - DNA, 705 bp, Homo sapiens
  misc_feature: GZ8MTXP01ESNUT.51.6.A06.1.454.CMB.2.raw
  modified_base (674)..(674): a, c, t, g, unknown or other
  misc_feature (674)..(674): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggtttttcctcgttgcttacgttttaagaggtgtccagtgtcgaggtgcagctggtgcgaggtcggtgggggacggcggtggtccgagtccgtgggacgtccctgacgtactctccgtgtacgacgtcctgtggtacttcgagtcttacgaggttaccgtagttcgggtttcgccgtcggttcgggtacccgccgtacggccgtacccggaagggtacgaaacgggggtcgtcggacggtaggggttgggtcgactattactaactactacgtaagttaaggaggaaaaaacgggaataaccgtaaaagtaaactaccgtaacgacgtaacgtaccggttaccggagggtaaaccggtcctaactccgaaaccctagttaaccgaccgaaaggaaccctaaacaaacccgtaccaaaagttaacccaacggtttaactttacacgaacgtaaacctaaacgtaccgaacctaccgtagtaacgtactacgggacgaacgtcgttacttgttacttagttgttgcgnggaagtggaactgaccgataacgaacgaacg

SEQ ID NO: 322754 - DNA, 706 bp, Homo sapiens
  misc_feature: GZ8MTXP01CLSQ6.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgacccaaacccatattcttattggtaccagcagaagccaggccaggcccctgtgttgtgatatataaagacactgagacggtccttcgagggtactcccgtgagcgtattctctcggcctacaccgtcgaagggtaaccaaagtcggtacaactattacgacctactcgagtggacgtaccgaagggaccaaaggaaggaacgacgggtctacggtaacttaagtttccgtagttacctaaagttcctttacgaaagtacctaaagttccgtaaggtttacggtttaaacctttagttcggtttaccgttaaccggggtaaaccgttcgggggtaaaacccgttaaacggggttcccgaaaccccggtttacccgtaacgggggtttaccccaacgggttaaccccccgtaaaaccggggacccccctaaaacccccgtacgttaccggttacccgtaacccgtttccccgttttccccccggg

SEQ ID NO: 322755 - DNA, 782 bp, Homo sapiens
  misc_feature: GZ8MTXP01A7SEB.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcgaggtgcagctggtgcgaggtcgtgggggagcgtggtccaggccgtgggagtccctgagactctcctggtcgacgcctcgtggtattcagtccttacgaggttacgtagttgggtttcgcccggtcggttcggggtccccaccgtacggtccgtacccgagggacccgaagggggtctcggcgtagggggtgggtcgactacgttacttaagtactaacgtaagttaagtaagggaaaaaaacgggaaactaacgttaaaaactttaaaacgtaaacccgtacccgggaaacgtaacggggtaaccccgttacccgggttaagggggaaaaccggggtccccttaaacgttacccaaacccgtactttacccgtaaacccgaaaggtaaaccgtaaacccaaaaccctaaccccgaaaaacgttaacccctaacgtttaaaccttttaccaacgttaaccgaaaacaaaaccgttaccggaaacctacccggttagacccgtagtacgggaaccgtaacgtacgggttactaggttattaagttagggttcgaggacgggaagggacgggtaatacgtcaagtcccgaagaacccg

SEQ ID NO: 322756 - DNA, 699 bp, Homo sapiens
  misc_feature: GZ8MTXP01EKVH4.51.6.A06.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtcccgtcgtccccaggacagacggccaggatcacctgctcgtgganatgcattcgacccaaccctnttattcttatggtaccagcaagaacgccaggccacggccctgtgttgtgatataanaaagacactgaagacggtccttacgagggtactcccgtagacgcgtactttccgtcgttggacctcccaacccgtaacgagggaactaagtcggtaccatagttcgacctatcgaggttggacgtccgaaggacgaaaggaacgacggaggtctacgtaaactttcgtttcgtcgggttaactaaagtttccttacgaacgtaacctagttcgtaaggtttcggttaaactttagttacggttaccggtttaacgggtaaaccgttacgggggtaaacccttaaacgggtcccgttaacccgggttacccggttaacgggttacccaacccgggtaaacccccgaaaccgggttaacccccaaaaccccgttcgttaacccggttaaccctttaaccccgg

SEQ ID NO: 322757 - DNA, 536 bp, Homo sapiens
  misc_feature: GZ8MTXP01DL5T7.51.6.A06.1.454.CMB.2.raw
  modified_base (211)..(211): a, c, t, g, unknown or other
  misc_feature (211)..(211): n is a, c, g, or t
  modified_base (287)..(287): a, c, t, g, unknown or other
  misc_feature (287)..(287): n is a, c, g, or t
  modified_base (317)..(317): a, c, t, g, unknown or other
  misc_feature (317)..(317): n is a, c, g, or t
  modified_base (378)..(378): a, c, t, g, unknown or other
  misc_feature (378)..(378): n is a, c, g, or t
  modified_base (436)..(436): a, c, t, g, unknown or other
  misc_feature (436)..(436): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctctatgtgctgacacagccaccctcggtgtccgtgtccccaggacagacggccaggatcactgctntggagatgctattgaccaacccatattcttattggtaccagcagaagcaggcagccctgtgttgtgatatataaanacactgagagctttcgaggatccctagagngacttccgtctggctccacctacagggaacaaagtggtacaactattcgacatcagtgganccgaagacgaagaaggacgagggctagacttaatttcgtgtacaaattccttaagaanatatagtagtagtattatgtcgtaacgtaacgttaggacgaacgtacgtaccgttacgttacgttacgaacgaccgaaccgacccacccactcgttcgtc

SEQ ID NO: 322758 - DNA, 684 bp, Homo sapiens
  misc_feature: GZ8MTXP01CBYXS.51.6.A06.1.454.CMB.2.raw
  modified_base (312)..(312): a, c, t, g, unknown or other
  misc_feature (312)..(312): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggtttttccctcgttgcttctttttaagaggtgtccagtgtcaggtgcagctggtgcaggtcgtgggggaggcgtggtccagcctgggacgtcctgacgactctcctgtgaagtcctctggattcagcttcgagttacgtagttggtttgcgtcgtggggtcccnccgacggctccgaggcgtaaacgggggcttgggcgtagggtgggggttcggacctagttcctaattactacgtaaatagtaggaaaaaaagggaacgtaactaaaattaaaactaaccgtaacgacaacggtacttacccggtaaggaacggggtacctaattaccaacctaacttcctaacccaagaaacgaacaaactaacccgaaagtaaccctaacgtaacttttaatacctaagaaactaaacgtacgaacctaccgtagtaacgtacgtacggaacgtaacgtacgttcttacgttacttaacgtttagttggttcggttacggaagggtaaggtaacgtacgtacgttactaaccgaacgtaacg

SEQ ID NO: 322759 - DNA, 806 bp, Homo sapiens
  misc_feature: GZ8MTXP01BUR19.51.6.A06.1.454.CMB.2.raw
  modified_base (322)..(322): a, c, t, g, unknown or other
  misc_feature (322)..(322): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccaggccgtggggacgtccctgacgtacctctctgtagacgcctcgtggtattcgagtcttacgagttacgtagttggtttcgcggtcgtcgggtccccncgaggtcctaccggaggacgaagggtctggacggtagggttcgggtgactagttactatatacgaagttaagtaaggaaaaaagggaactaaccgtaaaattaaaaccgtaccgtaaccggactaacgggtaaccgtttacccgggaacgggtaaaccggggtaccccttaaacgtttaccccgaaacccctaagtttacccccgtaaaccggaaaacggtaaacccggtaaaaccctaaaaccccgttaaacccccgaaaaaaggtaaacccctaaccgtttaaaacgttttacaaaccgttacgaaaaccctaaaacgttacccgaaaaccctacccggtagtaaaccggtacgttaacggggaacgtaaccgtacggttactttaccggttactttaagttacggtttaggccgggaacgggtaacggggtaaggggtaattaaccggtacccgggttaaacgtaacccggaaccgtaacg

SEQ ID NO: 322760 - DNA, 774 bp, Homo sapiens
  misc_feature: GZ8MTXP01CN3WV.51.6.A06.1.454.CMB.2.raw
  modified_base (320)..(320): a, c, t, g, unknown or other
  misc_feature (320)..(320): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagctggtgcgaggtcggtgggggaggcgtggtccaggccgtgggacgtccctgacgctctctgtcgacgcctcgtggtattcagcttacgaggttacgtagttggtttcgccgtacgtcgggtcccnccgaggtcctccgaaggacgaaggggacctggccgtaggggtgggttcgactagttcgttaatacgtacaagttagtagggaaaaaaggaaactaaccgtaaaattaaaacgtcccgtaaacggaccaaacggtacccgtaccgggttaacgggaaacggggtaccctacttaccgaaccctagttacccaaccgaagaacgaaacctaaacctaaccccgaaaagtaaaccctaacgtttaacgttttaaactccgtaacggtaaacctaaaaccgtaccggaaaccctaaccccgtttaggaaaccgtaccggttaaggaacccgggtaacgtacccggggttactttaccgtttaaacgtttaaagttttcgtttggggacgggaccgggttaaaggggaagggggttaactaacggttaaccggacttaacccggaaaaccgtaaccggg

SEQ ID NO: 322761 - DNA, 562 bp, Homo sapiens
  misc_feature: GZ8MTXP01DI1I5.51.6.A06.1.454.CMB.2.raw
  modified_base (363)..(363): a, c, t, g, unknown or other
  misc_feature (363)..(363): n is a, c, g, or t
  modified_base (434)..(434): a, c, t, g, unknown or other
  misc_feature (434)..(434): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctggggttttcctcgttgctcttttaagaggtgtccagtgtcaggtgcagctggtgcagtcgtgggggaggcgtggtccagcctggggaggtccctgagactctcctgtgaagcctctggattcagcttcagtacgtatggtttgcgctgggtccgcaggctccaggacaagggctgcaggtgggtgcatctatatcatatggaaaagagcaaataaanactacgcagctccgtagaggcatcacatctccagacacaaactccaaagaaccactaactttagtacctanaacaaactacgaacctaccgtagtacgtacgtacggaacggaacgtcggttcttacgttacgttaagtttagttcggttcggttacgggaagggtagggtaagtacgtacgttataaccgaacgaacg

SEQ ID NO: 322762 - DNA, 596 bp, Homo sapiens
  misc_feature: GZ8MTXP01CUAGC.51.6.A06.1.454.CMB.2.raw
  modified_base (309)..(309): a, c, t, g, unknown or other
  misc_feature (309)..(309): n is a, c, g, or t
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcgaggtcgtgggggaggcgtggtccagccgtgggacgtccctgagactctcctggtagaacgcctctggattcagcttcagttacgtatggtttgcgtcgtggggtcccncgaggctccgaggcaaagggctgcgnggtggtgcntctatatcatanggaaaagancaaataaanactacgcaagtactcgtagacgggctagtcacctatacctacaaggaacaccaaactaccccgaaagtaaccaaccgttaactttagtacctacggaactaaaagtaccggaaacctaacccgtagaacgtaacgttacggaacgaacgtacggacttcgttattaagttgttcggttggttaccggaaggaagggtcgtatacggactaaccgaacgtccg

SEQ ID NO: 322763 - DNA, 643 bp, Homo sapiens
  misc_feature: GZ8MTXP01BZGXT.51.6.A06.1.454.CMB.2.raw
  modified_base (383)..(383): a, c, t, g, unknown or other
  misc_feature (383)..(383): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggagcgtggtccagccgtgggacgtccctgacgactctcctggtgaacgcctctggattcagcttcgagtacgtagttggtttgcgcgtgggtcccgccgaggctccgaggcgaaggggactggcgtaggtggggtggctagtctaatactcgaatataggaaaaagggaancgtaaataaactacgtacgacaagacgtccggtagaacgggtccgtattaccactactacctacccaagaacgtaaccaaactacccaaagtaaacctacgttaactttactaccgtacgaacaaacgtacgaaacctacccgtagtaacgtacttacggacgggaactacgggttcgttacgttacgttatttaagtttgggttcggttaccggaagggtaggggtaagtacgttacggacttccgaaacgtaaccggg

SEQ ID NO: 322764 - DNA, 744 bp, Homo sapiens
  misc_feature: GZ8MTXP01AP4WA.51.6.A06.1.454.CMB.2.raw
  modified_base (323)..(323): a, c, t, g, unknown or other
  misc_feature (323)..(323): n is a, c, g, or t
  modified_base (355)..(355): a, c, t, g, unknown or other
  misc_feature (355)..(355): n is a, c, g, or t
  modified_base (377)..(377): a, c, t, g, unknown or other
  misc_feature (377)..(377): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagctggtgcgagtcggtgggggagcgtggtccgaggccgtgggacgtccctgacgtctctcctgtgacgcctcgtggtattcaggtcttacgaggttacgtagttgggtttcgccggtcgtcggggtccnccgaggtccctaccgagggacgtaaagggtcnggtacggtagggtgggggtacnctaacgttcctaaatactacgtaagttaagtagggaaaaaaacggaacgtaacctaaaataaaaccgtaccgtaccgaacgtaacggtaacccgttaccgggtaaggaaaccgggtacccttaacttacccaaacccttattaccccgacgaagtaaacccgaaacctaaaccttaacccggaaaactaaaccctaaccgttaaccttttaaacaaccgtaaacgaaacctaaacgtaccgaaacccgtacgtacgtaaacgtacgtacggaaccggtaaccgtacgttcttacgttacgtttaagtaggttcggacggaacgggtaaggtaacggtaactacgtacgttaactaaccgaacgtcgg

SEQ ID NO: 322765 - DNA, 723 bp, Homo sapiens
  misc_feature: GZ8MTXP01APVKH.51.6.A06.1.454.CMB.2.raw
  modified_base (309)..(309): a, c, t, g, unknown or other
  misc_feature (309)..(309): n is a, c, g, or t
  modified_base (397)..(397): a, c, t, g, unknown or other
  misc_feature (397)..(397): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggagcgtggtccagtccgtgggagtccctgacgactctcctgtagagcctcgtggacttcagcttacgagttacgtagtggtttgacgtcgtggggtccnccgaggcctccgaggtccaaggggtctggccaggtggttcggactatacgttactattcaagtaagtaggaaaaaaaacccgggaaanaactaaaattaaaaccgtaccgtaacgacgtaacggtaccgtaaccgggtaagggaaaccgggaccgtaacttaacccaaccgtaacgttaccgtaaccgaaaggtaaaccgaaaccctaaaccgtaaacccggaaaacgtaaacccgtaaccgttaacctttaacgtaccgaacgaaacctaaaaccgtaccgaaacccgtaacccgtagtaaccgttacgtacggaacggtaacccgtacgttcttacgttaaacgtttacgttaggttcggttaggacgggtaaggacgggtaatacgtaccggttaactccgaacggtaacg

SEQ ID NO: 322766 - DNA, 734 bp, Homo sapiens
  misc_feature: GZ8MTXP01DM5F2.51.6.A06.1.454.CMB.2.raw
  modified_base (259)..(259): a, c, t, g, unknown or other
  misc_feature (259)..(259): n is a, c, g, or t
  modified_base (305)..(305): a, c, t, g, unknown or other
  misc_feature (305)..(305): n is a, c, g, or t
  modified_base (389)..(389): a, c, t, g, unknown or other
  misc_feature (389)..(389): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggaggcgtggtccagccgtgggagtccctgagctctcctgtgaagcctcnggattcagcttcagttacgtagttggtttgccgtcgtcgggtcccnccgaggcctccgaggacgaaggggactggcgaggttgggggtcgctagttcctagtatacaagttaataggaaaaaagggtaanaactaaaataaaactaacctaacgacaacggtaccgtccggtaggtaacgggccctagttaccaacctactcctaacccaaggaacaacccgaaaactaccccgaaaactaaaccctacgtttaaaccttttactaccgtagtaaacctaaaacgttaccgaaacctaaccccgttaggaaaccggttaacgttacggggaaacggtaacccggtaaacccggggttcgtttacggtttaccgttttaaacgtttaacggtttcgggttcgggaaacgggtaaggggttaaacgggggaaggttaacgggtaaccggttaagttaaccgaaacccgggtaaccgg

SEQ ID NO: 322767 - DNA, 707 bp, Homo sapiens
  misc_feature: GZ8MTXP01BWT3L.51.6.A06.1.454.CMB.2.raw
  modified_base (415)..(415): a, c, t, g, unknown or other
  misc_feature (415)..(415): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggtttttcctcgttgctcttttaagaggtgtccagtgtcaggtgcagctggtgcgagtcgtgggggaggcgtggtccagccgtgggacggtccctgagactctcctgtgaacgcctcgtggtacttcagtcttacaggttacgtagttgggtttcgccgtcgttcggggtccccgccgaggtcctaccgagggaccgaaagggggcttcgggacgtagggttcgggggtgactagttcctaagtactcgaatagtaaggaaaagggaanaactaaagtaaaactaccgtacggactaacggaacccgttccgggtaagggaaaccggggtcctaactttcccgaaacctacgttacccgtaaccgaacggtaaaccgaacctaaacctaaccccgaaacgtaaaccctaacttaacttttacgtaccgttacgaacctaaaacgtacgaaaccctaccctagtaacgtacgttacggaacggtaacgacggttcttagttacttaagttagttacggttcgacggtaagggaggtaagacgtacgataaccgaacgtaacg

SEQ ID NO: 322768 - DNA, 692 bp, Homo sapiens
  misc_feature: GZ8MTXP01CP5VJ.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgaggtcgtgggggagcggtggtccagccgtgggacggtccctgagactctcctgtagacgcctcgtggattcagcttacaggttacgttagttgggtttgccggtcgtcggggtcccgccgacggcctccgagggcaagggggactgggcgagggtgggtcgctagttacctaattactacgataagtagggaaaaacgggaaagaacgaaaattaaaactaccgtaacgacgaacggtaccgtacccggtaagggaaacgggcccgtaattccaaccctagtaccgtacccgaaggaacgaaccaaaccgtaaccccaaagtaaaccctaacttaactttaactacttacgaacctaaacgtaccgaaaccctacccgtagtaacgtaccttagggaacgtaaccgacggttacttgttacgtttaagtagtttggttcggacggtaagggacggggaagtaacgtacggacttaaccgaacgtaaccgg

SEQ ID NO: 322769 - DNA, 770 bp, Homo sapiens
  misc_feature: GZ8MTXP01AYX1U.51.6.A06.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (273)..(273): a, c, t, g, unknown or other
  misc_feature (273)..(273): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagctggtncagtcggtggggagcgtggccagccgtgggacgtccctgacgtactctctgtacgacgcctntggattcgancttacaggttacgtatgggttcgacgtcgtacgggtcccgctacggcctcccgaagggacgtaaagggctaggcgtagggtgggtcgactacgttcttaaatactacgtaaagtaagtaaccggaaaaaaaggggaactaacgtaaaaaactttaaacgtacccgtacgaaccgtaaggaccctttacccgggaggtaaaccggggtccctaaacgttaccccaaccgtagtttacccccaaaccgaaagggaaacccgtaaccaaaacccttaaccccggaaaaaacgtaaaccccttaacgtttaaaccgttttaactaaccgtaaccgaaaccttaaaccgtaccgtaaaccccgtacgtaacgggtaacgttaacgtaccgggaacggtaaccccgtaggttacttaacgttaccgtttaaagttacgttcgggacgggttaacgggtaacgggagggtaacgtaacgtaccggactaaccgaacgtaaccgg

SEQ ID NO: 322770 - DNA, 677 bp, Homo sapiens
  misc_feature: GZ8MTXP01AHMPX.51.6.A06.1.454.CMB.2.raw
  modified_base (617)..(617): a, c, t, g, unknown or other
  misc_feature (617)..(617): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagctggtgcaggtcggtgggggagcgtggtccgagtccgtgggacggtccctgacgtactcctcctgtcgacgcctcgtggacttcgacgtcttacgaaggttacgtagttgggtttcgcggtcgtcggggtccccgacgacgggtcctaccggaaggacgaagggggtactggaccgtagggtgggtcgctatcttaatacgtcaattaagaggaaaaaaaggtaacaactaaaattaaactaccgtaacggactaacggtacgtaccgggtagggaacggtaccctattaccaccattacccgaccaaggaacaaacctaaaccaaccgaaataacctaacgttactttacgacgtaacaaactaaacgtaccgaaacccaccgtaggtaacctaacgttacggaacggaacgtaccggttnttacgttatacgtttaggttcgaggttacgaagggtaggaacgtcacgataacgaacgcg

SEQ ID NO: 322771 - DNA, 451 bp, Homo sapiens
  misc_feature: GZ8MTXP01BZQYJ.51.6.A06.1.454.CMB.2.raw
  modified_base (291)..(291): a, c, t, g, unknown or other
  misc_feature (291)..(291): n is a, c, g, or t
  modified_base (337)..(337): a, c, t, g, unknown or other
  misc_feature (337)..(337): n is a, c, g, or t
  modified_base (366)..(366): a, c, t, g, unknown or other
  misc_feature (366)..(366): n is a, c, g, or t
  modified_base (403)..(403): a, c, t, g, unknown or other
  misc_feature (403)..(403): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (437)..(451): a, c, t, g, unknown or other
  misc_feature (437)..(451): n is a, c, g, or t
tcagcgatcgtatacacgaccggtgctcgatttagatctactgacaggggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgaccaaaccctataattcttaattggtaaccagacagaagccaaggccaggcccctgtgtgtgataanataaagcatgagagcttcaggctcctgagcgatctctcgctacacncagggaacaagtgcaacattagaccatanagagacgacgagagaagaagaagagatatactacttntatactatactactanactactntagtagtactnnnnnnnnnnnnnnn

SEQ ID NO: 322772 - DNA, 513 bp, Homo sapiens
  misc_feature: GZ8MTXP01E5FYV.51.6.A06.1.454.CMB.2.raw
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (473)..(473): a, c, t, g, unknown or other
  misc_feature (473)..(473): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttaattggtaccagcagaagccaggccaggcccctgtgttgtgatatataaagacactgagaggccttcagggatccctgagcgattctctcggctcactcaggaacaatgtcacattgaccatcagtgagtccagggcaggaagacgaagggctagacttatttctgtcaaagtcttcagacaattcagtggtactatntnttcggaatgggacagggtcaccggtccttagggcngaccccaaggcccaaccccatcgttactaacttcgttccg

SEQ ID NO: 322773 - DNA, 683 bp, Homo sapiens
  misc_feature: GZ8MTXP01AIMRG.51.6.A06.1.454.CMB.2.raw
  modified_base (527)..(527): a, c, t, g, unknown or other
  misc_feature (527)..(527): n is a, c, g, or t
  modified_base (638)..(638): a, c, t, g, unknown or other
  misc_feature (638)..(638): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgtcttcttttaagaggtgtccagtgtcaggtgcagcgtggtgcgaggtcggtgggggaggcgtggtccagccgtggggacgtcccgtgacgctctccgtggtacgaacgtcctcgtggtacttcgacgtcttacgagttacgtagttggtttcgcgtcgtcgggtccgccgacggcctccgaggcgaagggtctgcgtagggtggtcgctatacgtatagtactaagtaacgtaggaaaaaagggaataactaaaattaaacgtaacctaacgacgtaacgtaccggttacccggtagggaacgggtacctaacttaccgaaccctatacccgtaacgaagaaccgtaaacaaccgtaacccgaaanaaccctaacttactttaacgtaccgaacgaactaaaccgtagaaccccgtaaccgtagtaagtacccgtaaggacgaaccgtcggttacttcgttaacgttatttgttggnggaccgtaaggggagtaacgaggtcccttaaagccgaagtaaccg

SEQ ID NO: 322774 - DNA, 915 bp, Homo sapiens
  misc_feature: GZ8MTXP01AMAAP.51.6.A06.1.454.CMB.2.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
  modified_base (859)..(859): a, c, t, g, unknown or other
  misc_feature (859)..(859): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtncagctggtgcaggtcgtgggggngcgtggtccagccgtgggacgtccctgacgtactcctcgtggtacgaacgtcctcgtaggtacttcgaacggtcctttaccgaggttaaccggttaggttcgggttttcgcccgggtccgtttcgggggtcccccgaaccggacggtccccgttaccccgaaggggaccgaaaacgggggtcctcgggaccggttaaggggttcgggggtacgacctaacgtttaccgtaacttaacggtcctaaagtttaaagggtaaccggaaaaaaaacgggggttaaagtaaccccgtttaaaaaaatttaaaaaacccgttacccgggttaaacccgggtaacccgaaaacgggtttaaacccccgttaccccgggggttaaacggggaaaacccgggggttacccccggttaaacgtttaccccaaacccgttaaccgtacccgggttaaacccggaacgggaaaacccctaaacgttaaacccccgaaaacggtaaaccttaacccttaaacgtttttaacgtaccctttaacggaaaccttaaaaaccgttaaccaaaacccgaccccgtttaagggtaaccgtaacccgttaggaaccgggaacctaacgggtacctttaggtacctttagtttaaaccgttcggngggaccgaggggttaagggataacgttacggaacttaccgtaacgaacccgaaccg

SEQ ID NO: 322775 - DNA, 708 bp, Homo sapiens
  misc_feature: GZ8MTXP01C63EM.51.6.A06.1.454.CMB.2.raw
  modified_base (502)..(502): a, c, t, g, unknown or other
  misc_feature (502)..(502): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggaggcgtggtcaggccgtgggaggtcctgagactctctgtgaagcctctggatcagcttcagttacgtagttggtttgcgtcgtgggtccccgcgacggcctccgaggcgaacgggggacttggacggaggtgggggtgcagttctaattactctaagttagaggtaaaaggaaagaactaaaagtaaaactaacgtacgacaaacgaccgtacggtacggaaacggggaccctaagttacccaaaccctactacctaccgtaagaaacgaaaccaaactaaccccgaaaanaaaccctaacttaactttaactaccttacgaaactaaacgtacgaaacctaacccctaggtaacggtaacgttacggaacggggaacctaccgggttacgttaccgttaacgtttaaacgtttcgtttacgggttggttaaccgggtaaacgggggaacgggtaaggtaaacgtcccggaaaacgttccgaaacccggtaacccgg

SEQ ID NO: 322776 - DNA, 623 bp, Homo sapiens
  misc_feature: GZ8MTXP01A6MS2.51.6.A06.1.454.CMB.2.raw
  modified_base (319)..(319): a, c, t, g, unknown or other
  misc_feature (319)..(319): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagctggtgcaggtcgtgggggaggcgtggtccaggccgtgggacgtccctgacgtactctccgtgtcgaacgcctcgtggattcagcttcgagttacgtagttggtttcgccgtcgtcgggtcccncgaggcctccgaggcgaaggggctggcgtagggtgggtgctatctaatatcaatagtaggaaaacgaataactaaataaatacctaacggcaaggtacctaccgggtagaacgggtcctaacttccaacctatcccgtacaagtacgaacaactacccaaagtaacccagttactttaacactagaactaaagtcgaacctacccgtgtaacgtactagggacgaacgtaacggttctacgttctaagtttagttggttcggacggtaaggaggggtaatacgtacggactccgaacgtaacgg

SEQ ID NO: 322777 - DNA, 663 bp, Homo sapiens
  misc_feature: GZ8MTXP01CUMIQ.51.6.A06.1.454.CMB.2.raw
  modified_base (338)..(338): a, c, t, g, unknown or other
  misc_feature (338)..(338): n is a, c, g, or t
  modified_base (438)..(438): a, c, t, g, unknown or other
  misc_feature (438)..(438): n is a, c, g, or t
  modified_base (645)..(645): a, c, t, g, unknown or other
  misc_feature (645)..(645): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggttttcctcgttgtcttcttttaagaggtgtccagtgtcgaggtgcagctggtgcgtaggtcggtggggggaggtcggtgggtccgaggccgtggggacggtcctggacgtactctccgtggtgaacgtcctcgtaggacttcagtcttacaggttacgtagttggtttcgccgtcgtcggggtccccncgaggcctaccgagggacgaagggggctggacgtagggtggggtcgctattctattatacataagtaggaaaaagtaagaactaaaataaactacgtacncgaataccgtcgtaggaacggtacgtataccaactactactacaagacgaacctaacgtaacccaaagtaacctaaacttactttaactaccgtaactaacctaaataccgaaacctacccgtagtaacgtaaccgtggaaaccggtcgacggttacttacggttactttaaagttgttacggttggacggtaagggacggaagtanacgactcgaacgtaacgg

SEQ ID NO: 322778 - DNA, 718 bp, Homo sapiens
  misc_feature: GZ8MTXP01BDOB0.51.6.A06.1.454.CMB.2.raw
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacacgcccaccctcggtgtcccgtgtccccaggacagacggccaggatcacctgctctggagatgctattcgacccaaccctacttattcttagttcggtaccagcagaacgccaggccacggccctgtgttgtgatatataaagacactgagaggtccttcgaggactccctgacgcgtattcgtcgtcggcctaccacccgtacgaacgggaaccaagtgggtacacgtattcgaacctagtaccgaaggttcggacgttacccgaaggggaccgaaggtaaacgggaaaccgggtgggtaccgttaggtaaaccgtttaatttccgtacggttactaaacgtttcccctttaagaaacggtaccgtaattccgtaaggtttaggtttaacctttaagttcgttaccgttaccgggttaaacgtaaccgggggtaaccgttaaacgggttacccgaacccggttacgttaaacggggttcccaaaccggaccccgtaaaccgggaccccccgtaacccctaacgtccggttaccctaacctttcccggtttaacccccg

SEQ ID NO: 322779 - DNA, 671 bp, Homo sapiens
  misc_feature: GZ8MTXP01D5RUF.51.6.A06.1.454.CMB.2.raw
  modified_base (240)..(240): a, c, t, g, unknown or other
  misc_feature (240)..(240): n is a, c, g, or t
  modified_base (654)..(654): a, c, t, g, unknown or other
  misc_feature (654)..(654): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgagtcgtgggggaggcgtggtccagccgtgggacgtccngacgactctctgtcgaacgcctctggatcagctcagttacgtagttggttcgcgtcgtcgggtccgcgaggcctccgaggcgaagggtactggcgaggtgggtcgactagtctaagtactacgaagtaagtaggaaaaaaggtaagaactaaaattaaaacgtaaaccgtaacgacctaaacggtaccgttacccgggtaggaaacggggtacctaacttaccgaacccttactaccgtaaccaaacggaacgaaacctaaaaccgtacccaaaacgtaacctaaccgttaacttttaacgtacctaacgaactaaactacgaaacctaccgtagtacgtaacgttacggaggtaaccgtcgttcttacgttactagtttagttcggttcgacggaaggtagggaactacgtanactaacgaacgtaaccg

SEQ ID NO: 322780 - DNA, 827 bp, Homo sapiens
  misc_feature: GZ8MTXP01EZCTX.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggtttttcctcgttgcttcttttaagaggtgtccagtgtcaggtgcagcgtggtgcaggtcggtgggggaggcgtggtccgaggccgtggggacggtccctgacgtacttctccgtggtagacgtcctcgtggtatcgagtcttacgagttacgtagttgggtttcgcggtcgtggggtccccgccgaggcctccggaggacggaacggggctcggcggtaagggggtcgggtagactattaccttaataactctaaagtaagtagggaaaaaaaacgggtaataactaaaaagtaaaacgtacccgtaacgaccgtaacggtaccgttaccgggtaacggggtaaaccggggtaccttaacgttacccaaacccttaacgtaccccgttaaccgaaacggtaaaccgaaaaccctaaaccccgtaaacccgaaaacgtaaacccttaaaccgggttaacctttttaaaccgaccgtaaacgtaaaccgtaaaacgttacccgaaaaccccgtacccgttaaagggtaaccggttaacgttaaccggggaaacggggtaaccccgtaacggggtttactttacggtttaacctttaaggttttaaccggttgggttaacgggttagggaaacgggaggggtaacgtacgtacggttaacctaaccgaacggtaaccccg

SEQ ID NO: 322781 - DNA, 636 bp, Homo sapiens
  misc_feature: GZ8MTXP01A49PV.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcgaggtcgtgggggagcgtggtccaggccgtgggacggtccctgacgactctcctggtgaacgcctcgtggacttcagcttcgagttacgtagttgggtttcgcgtcgtcggggtcccgccgacggtcctcccgagggacgaaggggactggcgtaggtgggggtcgcgtatcgtatagtctaagtaagtagaaaagggaataactaaataaactactacgacacgaacgtcgtaggaacggccacgttaccacctactaccaccgaagaacgaacctaaacctaccgaaactaaccaacttaactttactacgacgtaactaaacgtacgaaacccgtactaggtaacgtactacgggaacggtaaccgacgttcttgttaacgttagttaacttggttcgaggaagggaggaagacgtcgaatcgaacgaaccgg

SEQ ID NO: 322782 - DNA, 621 bp, Homo sapiens
  misc_feature: GZ8MTXP01CU79D.51.6.A06.1.454.CMB.2.raw
  modified_base (287)..(287): a, c, t, g, unknown or other
  misc_feature (287)..(287): n is a, c, g, or t
  modified_base (309)..(309): a, c, t, g, unknown or other
  misc_feature (309)..(309): n is a, c, g, or t
  modified_base (558)..(558): a, c, t, g, unknown or other
  misc_feature (558)..(558): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccaggccgtgggaggtccctgacgactctcctggtgaagcctcgtggattcgagcttcagttaacgtntggtttgccgcgtcggggtccncccgaggcctcccgagggcaagggggacttggaccgaggtgggtgcatctatatcattagaggaaaacgagctaaataaactactacggacacgtaccgttaccggaggaacgggccgtaagttccaaaccgtacgtacgtacccaagacgtaaccaacgtacccaaagaacccaactaaccgtttattacctacgactaaaatccggaaacacccgttgaacgtaccgttagacggaacaccgggttnttacgttagttaagttgttaggttggacggaaggaggaacgtataccgttactaacgaacgcg

SEQ ID NO: 322783 - DNA, 667 bp, Homo sapiens
  misc_feature: GZ8MTXP01B1R1C.51.6.A06.1.454.CMB.2.raw
  modified_base (639)..(639): a, c, t, g, unknown or other
  misc_feature (639)..(639): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgaggtcgtgggggaggcgtggtccaggccgtgggacgtcctgacgctctctgtcgacgcctctggatcagtcttacgagttacgtagttggttgccgtcgtcggggtcccgccgtacggcctccgaggacgaagggggctggcgtagggtgggtgctatcgtaatagtacaagtaagtacggaaaaaaggaacaactaaaaataaaccgtaccgtacgaccgtaacgacccgtacggtaacggaacggacccgtaattaccaaccataccgtacgaacgaacgaaccaaactaacccaaaagtaacctaacgttaactttactaccgtacgtaacaaacgtacgaaacctacccgtagtaacgtacgttacggacgtaaccgacgttcgttacgttattaaacgtttgttaggttcggaacgggaaggtacgggtaanacggtacgttacgtaacgaacgtaaccg

SEQ ID NO: 322784 - DNA, 632 bp, Homo sapiens
  misc_feature: GZ8MTXP01DAIG2.51.6.A06.1.454.CMB.2.raw
  modified_base (295)..(295): a, c, t, g, unknown or other
  misc_feature (295)..(295): n is a, c, g, or t
tcagcgatcgtatacacgaccggtgctcgatttagatctactgacaggggggtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggactcacctgctctggagatgcattcgccaaacctattattcttattcggtaaccagcagaacgccgaggccaggccctgtcgttgtgatataanaaagcaactgacgagtcctacgagggtactcccgtgagtacattctctacggctccactcgacggaaacaagtcgtacactatacgaccagcgagtgagtccgagcgaagaacgaacgaggactcgattattcgagttaactaagggttcttaacgagtaaccgtactcgtacggttacgggtttaaactttacgttcgtttaccgttaacgggaaccgttaacggggaaaccttaaacggggttaccacccggttaaacgtttacggaccgttacgaccccggaaaggaccccctaaacccgtacgtcggttacctaaccttcccgtttaaccccg

SEQ ID NO: 322785 - DNA, 602 bp, Homo sapiens
  misc_feature: GZ8MTXP01AYAR7.51.6.A06.1.454.CMB.2.raw
  modified_base (281)..(281): a, c, t, g, unknown or other
  misc_feature (281)..(281): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (363)..(363): a, c, t, g, unknown or other
  misc_feature (363)..(363): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggagcgtggtccaggccgtggggacgtccctagagtactctctgtagaacgcctcgtaggacttcagcttanagtacgtatgggtttncgtctcggggtccncgaggtcctaccgagggactaaagggggctggtcgaagggttgggggacganatactaactatataagtaagtaagaaaagaaagaactaaataaactaactacgacacgacgtacgtacggacggtacgtactacacactacacgaacgaacgaactaaacaacaaactaaacaactaacttactactacgaacaaactaacaacaacacgtagtacgtacgacgaacgacgttatacgttagttagttagttagttgagaaggaggaagagacgactaacgaacgaacg

SEQ ID NO: 322786 - DNA, 772 bp, Homo sapiens
  misc_feature: GZ8MTXP01AGZEH.51.6.A06.1.454.CMB.2.raw
  modified_base (272)..(272): a, c, t, g, unknown or other
  misc_feature (272)..(272): n is a, c, g, or t
tcagcgatcgtatacacgaccggtgctcgatttagatctactgacaggggggctgtgggtccaggaggcagaactctgggtgtctcaccatggcctggatccctctacttctccccctctcactctctgcacaggctctgaggcctctatgtgctgacacagcccacctcggtgtccgtcgtccccaggacagacggccaggatccacctgctcgaggagatgactattcgacccaaacccgtattattcttaagtggtaaccagcagaacnccaggccacgcctgtgtgtgatataataaagacacgtagagacggtacttggaacggtactccgtagacggtcgtattcccgtacgtggaccctcgaccgtaacgaacgggaactagtacggtcctaacgtactttacggaaacctagttaccgaagggttcgggaaccgtacccggaagggaaccgaaaggtaaaccgggtaacggacgggtaacttacggttaaacccgtttaaatttttcccgtaagggggtaacccttaaaaggtttttcctaaacggaaaccgttaacacgtaaccgtttaaggttcggtttaaacttttacggtacggtttaccgtttaaaccgggaaacggttacgggggtaaacccgttaaacggggttcccgtaaaccccgggtttaccggtttacggggttacctaaaccccgggtaaaccccggaaccgggttaaaccccccaaacccttacccggtttcgttaacccggtttaacccc

SEQ ID NO: 322787 - DNA, 768 bp, Homo sapiens
  misc_feature: GZ8MTXP01DDEKC.51.6.A06.1.454.CMB.2.raw
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
tcagcgatcgtatacacgaccggtgctcgatttagatctactgacagggggtctgggagacgagcccagcactggaagtcgccggtgttccattcggtgatcatcactgaacacagaggactcaccatggagtttgggctgagctgggttttcctcgttgctcttttaagaggtgtccagtgtcaggtgcagcgtggtgcagtcgtggggggagcgtggtccagcgtgggagtcctgagactctcgtgtgaacgcctcgnggtacttcagctacgagtacgtatggttgccgngtcggtcctcgaggctacccgaagggtacaagggactggccagggtgggttagcattactagtatacagttacgtaggaaaagggtaacaacgtaaaataaaacgtaccgttaaacgacccgtaaaggtaccgtacccgggttaggaaacgggggtcccgtaaaacgttccgaacccttaacaaccggtttccaaaccggtaacggaacctaaaaaccctacccggtaaaacgaaacccgtaacgtttaaacccggttttaaactaaccgggtttaaccccgaaagtaaaacttacgggaaaacccctaaccggttaacgggaaactacccgggtttaacggaaaggttaacccgaaacggggttccttacgttaacggtttaaactttaggttaccgggttacgggaccggttaaacggggtaaaagggccgggtaattacccgggttaacgtaaccttaacggtaaaccccgg

SEQ ID NO: 322788 - DNA, 770 bp, Homo sapiens
  misc_feature: GZ8MTXP01CODDC.51.6.A06.1.454.CMB.2.raw
  modified_base (276)..(276): a, c, t, g, unknown or other
  misc_feature (276)..(276): n is a, c, g, or t
  modified_base (293)..(293): a, c, t, g, unknown or other
  misc_feature (293)..(293): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgagtcgtgggggagcgtggtccgagccgtgggacgtccgtgacgactctctgtagacgcctctggattcagcttnagttactagtggtttancgtcgtcgggtcccgcacggctccgaggcgaagggtactggacgtaggtggggtcgtctagtcttactaatacgaattaaaggtaggaaaaaagggtaaactaactaaaagtaaaacttacgggtaaccgacaaaccgggttacgtaaccgggtacgggtaaacggggtacccgtaacgttaacccaaacccgtagttaacccgttaccgaacggaacggtaaacctaaaaccgttaaccccgaaaacggtaaaacccgtaaccgttaaccttttaaacgttcgttaaaccgaactaaaaccggttacgtaaaacccgtacccctttaacgggaaacgttaaccgtttaacgggacgggggtaaaccctacgggttaacgtttaccggttattaaaccggttttattaacgggggttcttaacgggaacgggggaagggtaaccgaagggttacgaacgtttcgaacggttaaccgg

SEQ ID NO: 322789 - DNA, 487 bp, Homo sapiens
  misc_feature: GZ8MTXP02HZF7S.51.6.A06.1.454.CMB.2.raw
  modified_base (394)..(394): a, c, t, g, unknown or other
  misc_feature (394)..(394): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttatggtaccagcagaagccaggccaggcccctgtgtgttgatatataaagacactgagaggccttcagggatccctgagcgattctctggctccacctcagggacaatggtcacattgaccatcagtgagtccagcagaagacgaggctgactattcngtcaatcttcagacatcaagtggtactatgtctcggaactgggaccaaggtcacgtctaggtcagcccaaggccaacccactgtcactctccg

SEQ ID NO: 322790 - DNA, 498 bp, Homo sapiens
  misc_feature: GZ8MTXP02G0OLY.51.6.A06.1.454.CMB.2.raw
  modified_base (284)..(284): a, c, t, g, unknown or other
  misc_feature (284)..(284): n is a, c, g, or t
  modified_base (428)..(428): a, c, t, g, unknown or other
  misc_feature (428)..(428): n is a, c, g, or t
  modified_base (439)..(439): a, c, t, g, unknown or other
  misc_feature (439)..(439): n is a, c, g, or t
  modified_base (476)..(476): a, c, t, g, unknown or other
  misc_feature (476)..(476): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggtttncgctggggtcccgccagggcctccgaggcaaggggactgcagtgggtgcatctatatcatatgaaaggaagcaaataaatcacgcaagactccgtagaaggccgatcacatctccagagacaatcccaaagaacaacactttanctagacaaatnaacacctgagactgagacacggctcgtctatatgtgngaagaggagatcgatacacacg

SEQ ID NO: 322791 - DNA, 493 bp, Homo sapiens
  misc_feature: GZ8MTXP02JMSHH.51.6.A06.1.454.CMB.2.raw
tcagcgatcgtatacacgaccggtgctcgatttagatctactgacaggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcagggatccctgagcgattctctggctccacctcagggacaatggtcacattgaccatcagtgagtccaggcagaagacgaggctgactattctgtcaaatcttcagacatcaagtggtacttatgtcttggaactgggaccaaggtcacgtcctaggtcagcccaaggccaacccactgtcactctccg

SEQ ID NO: 322792 - DNA, 529 bp, Homo sapiens
  misc_feature: GZ8MTXP02F92CQ.51.6.A06.1.454.CMB.2.raw
  modified_base (414)..(414): a, c, t, g, unknown or other
  misc_feature (414)..(414): n is a, c, g, or t
tcagcgatcgtatacacgaccggtgctcgatttagatctactgacaggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggcctttcaggggatcccctgagcggattcgctaggctccactcagggacaatgtcacattgaccatcagtgagtccaggcagaagacgaggctgactatttctgtcaatcttcanacatacagtagtacttatgttcgttacgtaacgtacggtacgaacggtaccgtaccgtaccgtacgtacgacgacccgaaccgacccgaacccacctacgtacctacctactccg

SEQ ID NO: 322793 - DNA, 489 bp, Homo sapiens
  misc_feature: GZ8MTXP02I6BSF.51.6.A06.1.454.CMB.2.raw
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcagggatccctgagcgattctctggctccactcaggacaatggtcacattgaccatcagtgagtccaggcagaagacgaggctgactattctgtcaatcttacagacatcagtggtacttatgtcttcggactgggacaaggtcaaccgtctaggtcagcccaaggcccaacccactgcactctccg

SEQ ID NO: 322794 - DNA, 491 bp, Homo sapiens
  misc_feature: GZ8MTXP02I9A59.51.6.A06.1.454.CMB.2.raw
  modified_base (347)..(347): a, c, t, g, unknown or other
  misc_feature (347)..(347): n is a, c, g, or t
tcagcgatcgtatacacgaccggtgctcgatttagatctactgacagggcacgaccggtgctcgatttagatctactgacaggggctgtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactatcttattggtaccagcagaagccaggccaggcccctgtgttgttgatatataaagaccactgagaggccttcagggntccctgagcgattctctggctccacctcagggacaatggtcacattgaccatcagtggagtccaggctagaagacgaggctggactattctgtcaattcttcagacatcagtgtaacttatgtcttcggaactgggactaacgg

SEQ ID NO: 322795 - DNA, 498 bp, Homo sapiens
  misc_feature: GZ8MTXP02HVY05.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccatattcttattggtaccagcagaagccaggccaggcccctgtgttgttgatatataaagacactgagaggccttcgagggatccctgagcgattctctcggctccacctcagggacaatggtcacattcgaccatcagtgagtccaggcagaagagaggctagactattctagtcaaatcttacagacatcagtgtactatgtctgaactgggactaaggtcacgtctacgtcacgaccaaggcccaacccactcgtaccacttcgtcc

SEQ ID NO: 322796 - DNA, 498 bp, Homo sapiens
  misc_feature: GZ8MTXP02I0ZTL.51.6.A06.1.454.CMB.2.raw
  modified_base (295)..(295): a, c, t, g, unknown or other
  misc_feature (295)..(295): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (418)..(418): a, c, t, g, unknown or other
  misc_feature (418)..(418): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggttgcgctgggtccncaggctccaggcaagggctgcagtgggtgcatctatatcatatgaaaggagcaaataaatactacgcagactcgtagaagggccattcacatcnccaganacaatcccaaagacacactttanctgacaaatagaacacctacgagactagaggacacggactcgtctattattagtgtcgaagaggagatacgatacacaag

SEQ ID NO: 322797 - DNA, 498 bp, Homo sapiens
  misc_feature: GZ8MTXP02GAMSO.51.6.A06.1.454.CMB.2.raw
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (443)..(443): a, c, t, g, unknown or other
  misc_feature (443)..(443): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttatggtaccagcagaagccaggccaggcccctgtgttgttgatatataaagaccactgagaggccttnagggntccctgagcgattctctggctccacctcagggacaatggtcacattgaccatcagtggagtccgaggcaagaagacgaggctagacttatttcngtacaattcttcagacatcagtgtaacttatcgtctacggactcgggactaacgg

SEQ ID NO: 322798 - DNA, 501 bp, Homo sapiens
  misc_feature: GZ8MTXP02HUEF4.51.6.A06.1.454.CMB.2.raw
  modified_base (423)..(423): a, c, t, g, unknown or other
  misc_feature (423)..(423): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggtttgcgctgggtccgccaggctccaggcaaggggactgcagtgggtggcatctatatcatatgaaggaagcaaataaatactacgcagactccgtgaaggccgattcacatctccagagacaatcccaaagaacacactttanctgacaaatcgaacaccctgagactagaggacacggctcgtctaattatgtgcgaagagggagatacgactcgaacag

SEQ ID NO: 322799 - DNA, 609 bp, Homo sapiens
  misc_feature: GZ8MTXP02JPNRU.51.6.A06.1.454.CMB.2.raw
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgggagatgcattcgcccaaacccacttattcttattggtaccagcagaagccaggccaggcccctgtgttgtgatatataaagacactgagaggtcctttcgaggggactcccctgagcgtattccctcgtggcctccacctcgaggggaccaagtcgggtacacctattacgacccatccaggttggaagtccgaggcaaggaacgacgagggctagacttattctgtactaatcttcaagtactatctaggttggttaacttagttcgtacgtttaccggaaacgtttcggggaaaccgtaaacgggttccctaacccggttaccgtacgggttaccaaccggaccccgaaaccgggacccccaaaaccccgtacttccggtacttaaccccg

SEQ ID NO: 322800 - DNA, 520 bp, Homo sapiens
  misc_feature: GZ8MTXP02JBE3J.51.6.A06.1.454.CMB.2.raw
  modified_base (354)..(355): a, c, t, g, unknown or other
  misc_feature (354)..(355): n is a, c, g, or t
  modified_base (442)..(442): a, c, t, g, unknown or other
  misc_feature (442)..(442): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggtttcctcgttagctcttttaagaggtgtccagtgtcaggtgcagctggtgcagtctgggggaggcgtggtccagcctgggaggtccctgagactctcctgtgaagcctctggattcagcttcagtacgtatggtttgcgctggggtccgccaggcctccgaggcaaggggctgcaggtgggtgcatctatatcatatgaaggaannaataaatactacgacacgactacgtacgacggacgactacacactactacacgagacacaccaacaacactacttatactacacaanacaacaccacgagacgtagacgacgacgacgtcgtactacttactacgtgagaaggaggagacgtacgactacacacg

SEQ ID NO: 322801 - DNA, 495 bp, Homo sapiens
  misc_feature: GZ8MTXP02F5MKM.51.6.A06.1.454.CMB.2.raw
  modified_base (408)..(408): a, c, t, g, unknown or other
  misc_feature (408)..(408): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcgagggatccctgagcgattctctggctccactcaggacaatggtcacattgaccatcagtgatccaggcagaagacgaggctgactattctgtacaatcttnagacatcagtgtacttatgtcttacggactgggaccaaggtccacgtctacggtcacgcccaagcccaacccactcgtcactctccg

SEQ ID NO: 322802 - DNA, 502 bp, Homo sapiens
  misc_feature: GZ8MTXP02I5Y9X.51.6.A06.1.454.CMB.2.raw
  modified_base (488)..(488): a, c, t, g, unknown or other
  misc_feature (488)..(488): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcgagggatccctgagcgattctctcggctccacctcagggacaatggtcacattgaccatcagtgagtccaggcagaagacgaggctagactagttctgtcaatcttcagactatcagtggtacttatgtcttcggaatcgggaccaaggtccacgtctacggcacgaccaaggcccaacccnctcgccactctccg

SEQ ID NO: 322803 - DNA, 516 bp, Homo sapiens
  misc_feature: GZ8MTXP02ICXP4.51.6.A06.1.454.CMB.2.raw
  modified_base (346)..(346): a, c, t, g, unknown or other
  misc_feature (346)..(346): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttatggtaccagcagagccaggccaggcccctgtgttgtgatatataaagccactgagaggccttcgagggntccctgacgcgattctctggcctccacctcgagggacaagtggtacactattcgaccatccagttggacgtccgaggcaagaacgacgaggctagactatttctgtcaattcttcagtacatctagtggtaacttagtcgttcgtacggtaacttcgggaacctaacggg

SEQ ID NO: 322804 - DNA, 502 bp, Homo sapiens
  misc_feature: GZ8MTXP02IZXIN.51.6.A06.1.454.CMB.2.raw
  modified_base (294)..(294): a, c, t, g, unknown or other
  misc_feature (294)..(294): n is a, c, g, or t
  modified_base (347)..(347): a, c, t, g, unknown or other
  misc_feature (347)..(347): n is a, c, g, or t
  modified_base (423)..(423): a, c, t, g, unknown or other
  misc_feature (423)..(423): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctggggttttcctcgttgctcttttaagaggtgtccagtgtcaggtgcagctggtgcagtctgggggagcgtggtccagcctgggagtccctgagactctcctgtgaagcctctggattcagcttcagtacgtatggttgcgctgggtccncaggctccaggcaagggctgcaggtgggtgcatctatatcatatgaaaggaancaaataaatctacgcaagactccgtagaaggccattcaccatctaccagacgacaatcccaaagaacacactttancctagacaaatgaaacaccctagagactgacgaacacggctgtactattatcgtgcgaagaggganacncgatcgacag

SEQ ID NO: 322805 - DNA, 511 bp, Homo sapiens
  misc_feature: GZ8MTXP02ITRHT.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcgagggctcccgtgagcgtattctctggctccacctcgaggggacaaagtggtacacattgaccatccgagtggacgtcgaggcaagaagacgaggctagactatttctgtcaatcttacagactatacagtgtaacttatgttactcggaacttcggaacctaacgg

SEQ ID NO: 322806 - DNA, 500 bp, Homo sapiens
  misc_feature: GZ8MTXP02HJRO5.51.6.A06.1.454.CMB.2.raw
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggtttccgtcgttaggctctttaagaggtgtccagtgtcaggtgcagctggtgcagtcgtgggggagcgtggtccagcctgggaggtccctgagctctcctgtgaagctctggattcagcttcagtagtatgttgtcgctggtccgccaggctccaggcgagggacgtgcgagtggtgggcatctatatnatatgaagaaganaataatacacgacagacgtacgtacgacggacgactacacactacacacacgacacaccaacaacactacttatactacacaacacacacacgagacgtagagacgacgatctatattatcgtgagaagaggagacgtacgactacacacg

SEQ ID NO: 322807 - DNA, 607 bp, Homo sapiens
  misc_feature: GZ8MTXP02F21I1.51.6.A06.1.454.CMB.2.raw
  modified_base (267)..(267): a, c, t, g, unknown or other
  misc_feature (267)..(267): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttcctcgttgctcttttaagaggtgtccagtgtcaggtgcagctggtgcagtctggggagcgtggtccagcctgggaggtccctgagctctcctgtgaagcctctggattcagcttnagtacgtgtggttgcgtcgtcgggtccgcgaggcctccgaggacgaagggctgcgtaggtgggtgctatactactatactatatagaagaagacaaataaataacgtacgacaacgacgtaccgtacggaacggaccgtactacacctactactaccaacgaacaacaaactaaccaaacgaaaccaactaacttactactacgtaactaaactaacgaaccaacctacgaacgtaacgtacgtaacggtaacgacggtacgttacgttacgttaacgtttacgttacggtacggtacggtaaggtaagggtaacggtacgtacgtaacgtacgacgacg

SEQ ID NO: 322808 - DNA, 496 bp, Homo sapiens
  misc_feature: GZ8MTXP02J1YSZ.51.6.A06.1.454.CMB.2.raw
  modified_base (232)..(232): a, c, t, g, unknown or other
  misc_feature (232)..(232): n is a, c, g, or t
  modified_base (410)..(410): a, c, t, g, unknown or other
  misc_feature (410)..(410): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccnctattcttattggtaccagcagaagccaggccaggcccctgtgttgttgatatataaagacactgagaggccttcagggatccctgagcgattctctggctcacctcagggacaatggtcacattgaccatcagtgagtccaggcagaagcgaggctgactatttctgtctaatcttnagacatcagttggtacttatgtcttacggaactcgggacaaggtcaccgtctagccagcccaaggcccaccactcgtcactctccg

SEQ ID NO: 322809 - DNA, 492 bp, Homo sapiens
  misc_feature: GZ8MTXP02GBO64.51.6.A06.1.454.CMB.2.raw
  modified_base (407)..(407): a, c, t, g, unknown or other
  misc_feature (407)..(407): n is a, c, g, or t
tcagcgatcgtatacacgaccggtgctcgatttagatctactgacagggggtgggtccaggaggcagaactctgggtgtctcaccatggcctggatccctctacttctccccctcttcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcagggatccctgagcgattctctggctccactcagggacaatggtcacattgaccatcagtgagtccaggcagaagacgaggctgactattctgtcaatcttnagacatcagtggtacttatgtcttcggaactgggaccaaggtcacgtctaggtcagcccaaggcccaacccactcgtcactctcg

SEQ ID NO: 322810 - DNA, 520 bp, Homo sapiens
  misc_feature: GZ8MTXP02JO6NR.51.6.A06.1.454.CMB.2.raw
  modified_base (295)..(295): a, c, t, g, unknown or other
  misc_feature (295)..(295): n is a, c, g, or t
  modified_base (333)..(333): a, c, t, g, unknown or other
  misc_feature (333)..(333): n is a, c, g, or t
  modified_base (388)..(388): a, c, t, g, unknown or other
  misc_feature (388)..(388): n is a, c, g, or t
  modified_base (400)..(400): a, c, t, g, unknown or other
  misc_feature (400)..(400): n is a, c, g, or t
  modified_base (418)..(418): a, c, t, g, unknown or other
  misc_feature (418)..(418): n is a, c, g, or t
  modified_base (464)..(464): a, c, t, g, unknown or other
  misc_feature (464)..(464): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggagtccctgagactctcctgtgaagcctctggattcagcttcagtacgtatggtttgcgctgggtccncaggctccaggcaagggctgcaggtgggtgcatctatntcatatgaaagagcaaataaatactacgcagactccgtagaggccgatcacatcnccagacgacaancccaaagacactacttanctagacaaatcgaaaccaccgtgaagtactgaacggacaccgggtntacgtacttagttacgttcgtagacggaaggaggacgtacgtacgactacaacgcg

SEQ ID NO: 322811 - DNA, 491 bp, Homo sapiens
  misc_feature: GZ8MTXP02JV8GY.51.6.A06.1.454.CMB.2.raw
  modified_base (295)..(295): a, c, t, g, unknown or other
  misc_feature (295)..(295): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
  modified_base (448)..(448): a, c, t, g, unknown or other
  misc_feature (448)..(448): n is a, c, g, or t
  modified_base (465)..(465): a, c, t, g, unknown or other
  misc_feature (465)..(465): n is a, c, g, or t
  modified_base (477)..(477): a, c, t, g, unknown or other
  misc_feature (477)..(477): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgctctttaagaggtgtccagtgtcaggtgcagctggtgcagtctgggggagcgtggtccagcctggggaggtccctgagactctcctgtgaagcctctggattcagcttcagtacgtatggttgcgctgggtccnccaggctccaggcaagggctgcaggtgggtgcatcatatcatatgaaggancaaataatacacgnagactcgngaagggccatcacatcncaganacanccaaagacacacttanctanacaancgaacaccgtagactagtagagacacggntacgtactattacgtgngagaaggagganacgcgactcacgag

SEQ ID NO: 322812 - DNA, 496 bp, Homo sapiens
  misc_feature: GZ8MTXP02JYEPZ.51.6.A06.1.454.CMB.2.raw
  modified_base (307)..(307): a, c, t, g, unknown or other
  misc_feature (307)..(307): n is a, c, g, or t
  modified_base (409)..(409): a, c, t, g, unknown or other
  misc_feature (409)..(409): n is a, c, g, or t
tcagcgatcgtatacacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgtgatatataaagacactgagaggccttnagggatccctgagcgattcctctggctccacctcagggcaatggtcacattgaccatcagtgagtccaggcagagacgaggctgactattctgtcaatcttnagacatcagttggtacttagtgtcttcggaactgggaccaaggtcaccgtctaggtcaagcccaaggcccaacccactcgtactacc

SEQ ID NO: 322813 - DNA, 341 bp, Homo sapiens
  misc_feature: GZ8MTXP02J0B4G.51.6.A06.1.454.CMB.2.raw
  modified_base (335)..(341): a, c, t, g, unknown or other
  misc_feature (335)..(341): n is a, c, g, or t
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccactattctattggtaccagcagaagccaggccaggcccctgtgttgttgatatataaagacactgagaggccttcagggatcctgagcgggctggcaaggcgcatagnnnnnnn

SEQ ID NO: 322814 - DNA, 591 bp, Homo sapiens
  misc_feature: GZ8MTXP02IRB8F.51.6.A06.1.454.CMB.2.raw
  modified_base (258)..(258): a, c, t, g, unknown or other
  misc_feature (258)..(258): n is a, c, g, or t
  modified_base (260)..(261): a, c, t, g, unknown or other
  misc_feature (260)..(261): n is a, c, g, or t
  modified_base (289)..(289): a, c, t, g, unknown or other
  misc_feature (289)..(289): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggtttcgcgttaggctctttaagaggtgtccagtgtcaggtgcagctggtgcagtctgggggagcgtggtccagcctgggaggtccctgagactctcctgtgagctctggtntnnctcagtagtatgttgcgcgtggtcgcgngcgtcgaggcgaggacgtgcgaggtgggtggcatctatatctatatagaagaagataaataaataacgtacgacgacgacgtacgtaggaacgggaccgtactacacctactactaccaacgacgaacaactaaccaaacgaaactaaacctaactttacttacgtacgtaacaaactaacgaacctaaccgtacgtacgtacgtacgtacggaacgacggtacgtacgttacgttacgtttacgttacggttaggtacggtaaggtaagggtaacggtacgtacgtacgtacgaacgaacg

SEQ ID NO: 322815 - DNA, 490 bp, Homo sapiens
  misc_feature: GZ8MTXP02HJDXB.51.6.A06.1.454.CMB.2.raw
  modified_base (363)..(363): a, c, t, g, unknown or other
  misc_feature (363)..(363): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgcattgccaacccactattctatggtaccagcagaagccaggccaggcccctgtgttgtgatatataaagacactgagaggccttcgagggatccctgagcgattcnctggctccacctcagggacaaatggcacattgaccatacagtgagtccaggcagagacgagctgactattctgtcaattctcagacatctagtgtaacttatgtcttacggactcgggacctaacgg

SEQ ID NO: 322816 - DNA, 503 bp, Homo sapiens
  misc_feature: GZ8MTXP02F8S75.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcgagggatccctgagcgattctctggctccactcagggacaatggtcacattgaccatcagtgagtccaggcagaagacgaggctgactattctgtcaatcttacagacatcgagtgtacttatgtctcggaactggaccaaggtctaccgtcgtacggtccacgacccgaaggcccaacccgactcgtacactctccg

SEQ ID NO: 322817 - DNA, 533 bp, Homo sapiens
  misc_feature: GZ8MTXP02G9E56.51.6.A06.1.454.CMB.2.raw
  modified_base (413)..(413): a, c, t, g, unknown or other
  misc_feature (413)..(413): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctcggctccactcgagggacaatcggtcactattgaccatcagtgagtccaggcagaagacgaggctgacttattctgtcaatcttnagacatcagtggtacttagtcgttcttcggaacttcgggaacctaaggtccaccgttcgtacggtccgacgacccgaacggacccaaaccccgtactaccggtacctaccgtcgttcccg

SEQ ID NO: 322818 - DNA, 505 bp, Homo sapiens
  misc_feature: GZ8MTXP02IMB57.51.6.A06.1.454.CMB.2.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (346)..(346): a, c, t, g, unknown or other
  misc_feature (346)..(346): n is a, c, g, or t
  modified_base (421)..(421): a, c, t, g, unknown or other
  misc_feature (421)..(421): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggagtccctgagactctcctgtgaagcctctggattcagcttcagtacgtatggtttncgctgggtccncaggctccaggcaagggctgcagtgggtgcatctatatcatatgaaaggancaaataaatactacgcagactcgagaggccgatcacatctaccagagacaactcccaaagaaccaactactttanctgacaaagtcaactaccctagagtactagacgacacggctgtactattcgttagtgacgaagagggagtagtacgatacacag

SEQ ID NO: 322819 - DNA, 519 bp, Homo sapiens
  misc_feature: GZ8MTXP02HD5Y1.51.6.A06.1.454.CMB.2.raw
  modified_base (424)..(424): a, c, t, g, unknown or other
  misc_feature (424)..(424): n is a, c, g, or t
  modified_base (505)..(505): a, c, t, g, unknown or other
  misc_feature (505)..(505): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccatattcttattggtaccagcagaagccaggccaggcccctgtgttgtgatatataaagacactgagaggccttacgagggatccctgagcgtattcctctggctccactcgagggacaagtggtcactattcgaccatcagtggagtccaggcagaagacgaggctgacttattctagtcaattctaganacatcagtgtacttagtgtcttacggactggaacctaaggtccaaccgtccgtaggtcaacgacccaacggcccaaacccnctacgtacctaccg

SEQ ID NO: 322820 - DNA, 562 bp, Homo sapiens
  misc_feature: GZ8MTXP02GF6MD.51.6.A06.1.454.CMB.2.raw
  modified_base (300)..(300): a, c, t, g, unknown or other
  misc_feature (300)..(300): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggaggtccctgagactctctgtgagcctctggattcagcttcagttacgtattggtttgcgtctggggtcccnccgaggcctccgaggcgaaggggacctggcgaggtggggtggcatctatatcatataggaaaggaagcaaataaactactacgcaagactccgtagaaggccgattcaccatctacccagacgacaaacgtacccaaagaaccactactttatactagacaaaacttcgaaaccacccgtagaacgtacgttagacggactacggtctacggttactatttacgtcggttggacgtaaggaggagacgtacgatcgacgacg

SEQ ID NO: 322821 - DNA, 512 bp, Homo sapiens
  misc_feature: GZ8MTXP02G7073.51.6.A06.1.454.CMB.2.raw
  modified_base (293)..(293): a, c, t, g, unknown or other
  misc_feature (293)..(293): n is a, c, g, or t
  modified_base (452)..(452): a, c, t, g, unknown or other
  misc_feature (452)..(452): n is a, c, g, or t
  modified_base (464)..(464): a, c, t, g, unknown or other
  misc_feature (464)..(464): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttatggtaccagcagaanccaggccaggcccctgtgttgtgatatataaagccactgagacggccttacgagggactcccgtgagcgtattctcgtcggctccacctcgagggacaagtggtacatattcgaccatcagtggacgtccgagcaagaacgacgaggctagactattcngtcatctcgaanacactactagtagtaagtattacgtacgtacgtacgtacgtacgtacg

SEQ ID NO: 322822 - DNA, 509 bp, Homo sapiens
  misc_feature: GZ8MTXP02HWU4W.51.6.A06.1.454.CMB.2.raw
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggcctttcgagggatccctgagcgtattctctcggctcccacctcagggaccaatggtcacattcgaccatcagtgatccagcagaagacgagctgactattcngtcaatcttnagacatcagtggtacttatgtcttacgaactggaccaaggtcaccggttctacggtcacgacccaaggcccaaacccgactcgtaccacttctcccg

SEQ ID NO: 322823 - DNA, 530 bp, Homo sapiens
  misc_feature: GZ8MTXP02HZHR3.51.6.A06.1.454.CMB.2.raw
  modified_base (411)..(411): a, c, t, g, unknown or other
  misc_feature (411)..(411): n is a, c, g, or t
  modified_base (511)..(511): a, c, t, g, unknown or other
  misc_feature (511)..(511): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtccccaggaccagacggccaggatcacctgctctggagatgcattgccaaccactattcttattggtaccagcagaagccaggccaggcccctgtgttgttgatatataaagacactgagaggcctttcagggatcctgagcgatctctggctccactcaggacatggtcacattgaccatcagtgatccaggcagaacgacgaggctgacttattctagtcaaattcttanagacatcagtggttacttatcgttactcggaaacgttcgggaaccgtaaaggtcctaaccggtcctaggtccaacgaccccgaaacggtcccaaaccccnctacgtcctactcttcccg

SEQ ID NO: 322824 - DNA, 519 bp, Homo sapiens
  misc_feature: GZ8MTXP02HE6L1.51.6.A06.1.454.CMB.2.raw
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (438)..(438): a, c, t, g, unknown or other
  misc_feature (438)..(438): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggtttcgtcgttaggctctttaagaggtgtcagtgtcaggtgcagctggtgcagtctgggggagcgtggtccagcctgggagtccctgagctctcctgtgagcctntggattcagcttcagtacgtatggtttgcgcgtgggtccnccgaggctccgaggctaaaggggctgcaggtgggtgcatcatatnatagagaaganataaataaatactacgacacgactacgacgacggacgtactacacactactacacgacaacaacaaccaaacaacaactacttatactanacaacacaacactacgagtacgtagacgacgacgctacgtatattacgtacgtgagaaggaggagacgtacgacacacacg

SEQ ID NO: 322825 - DNA, 496 bp, Homo sapiens
  misc_feature: GZ8MTXP02HH334.51.6.A06.1.454.CMB.2.raw
  modified_base (411)..(411): a, c, t, g, unknown or other
  misc_feature (411)..(411): n is a, c, g, or t
  modified_base (483)..(483): a, c, t, g, unknown or other
  misc_feature (483)..(483): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttatggtaccagcagaagccaggccaggcccctgtgttgtgatatataaagacactgagaggccttcagggatccctgagcgattctctcggctccacctcagggacaatggtcacattgaccatcagtgagtccaggcagaagacgaggctagactatttctgtcaaatcttanagacatcagttggtacttatgtactcgaactggaccaaggtcaccgtctaggtcagcccaaggcccaacccntacgcactctccg

SEQ ID NO: 322826 - DNA, 519 bp, Homo sapiens
  misc_feature: GZ8MTXP02HOYV0.51.6.A06.1.454.CMB.2.raw
  modified_base (341)..(341): a, c, t, g, unknown or other
  misc_feature (341)..(341): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggtttgcgctgggtccgccgaggcctccgaggcaaaggggctgcaggtgggtggcatctatancatatgaaacggagcaaataaatactacgacagactcgtgaaggccgatcacatcnccagagacanaccaaagaacacactttanctananaatacacaccgagacgtacgtagacgacgacgtctacgtacttattacgttgtagacgaaggagggactacgtacgactacacgacg

SEQ ID NO: 322827 - DNA, 493 bp, Homo sapiens
  misc_feature: GZ8MTXP02F50RO.51.6.A06.1.454.CMB.2.raw
tcagcgatcgtatacacgaccggtgctcgatttagatctactgacaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccactcagggacaatggtcacattgaccatcagtgagtccagcagaagacgagctgactattctgtcccaatcttcagtacatcagtggtacttatgtcttcggaactggaccaaaggtcacgtcctaggtcagcccaaggccaacccactcgtcactctccg

SEQ ID NO: 322828 - DNA, 559 bp, Homo sapiens
  misc_feature: GZ8MTXP02GSA60.51.6.A06.1.454.CMB.2.raw
  modified_base (253)..(253): a, c, t, g, unknown or other
  misc_feature (253)..(253): n is a, c, g, or t
  modified_base (342)..(342): a, c, t, g, unknown or other
  misc_feature (342)..(342): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattgccaacccactattcttattggtaccagcagaagccaggccaggcccctgtgttgtgatatataaagacactgagaggcttnagggctccctgagcgattctctggctccacctcgaaggggacaagtcggtacactattacgaccctatccgaaggttgggacgttacccgagggaccgaaggaaacggacggagggcttaggaaccttaatttcgtagttacctaaattccttacaagactatcgtaagttggtaaccttagtacgttacttacggaacgtcggggaacctaacggg

SEQ ID NO: 322829 - DNA, 539 bp, Homo sapiens
  misc_feature: GZ8MTXP02F08HR.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattctattggtaccagcagaagccaggccaggcccctgtgttgttgatatataaagacactgagaggccttcagggatccctgagcgattctctcggctccactcagggacaatggtcacattgaccatcagtgagtccagcagaagacgaggctgactattctgtcaatcttcagtacatcagtgtacttatgtacgtttcggaacttgggaaccctaaagggtccaaaccggttccgttaacgggtaccacggaccccgaaacgggaccccaaaaccccgacttcggtaccaacctctttacccg

SEQ ID NO: 322830 - DNA, 510 bp, Homo sapiens
  misc_feature: GZ8MTXP02IJJTT.51.6.A06.1.454.CMB.2.raw
  modified_base (408)..(408): a, c, t, g, unknown or other
  misc_feature (408)..(408): n is a, c, g, or t
  modified_base (491)..(491): a, c, t, g, unknown or other
  misc_feature (491)..(491): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttatggtaccagcagaagccaggccaggcccctgtgttgtgatatataaagacactgagaggccttcgagggatccctgagcgattctctggctccactcaggacaatggtcacattgaccatcagtgagtccaggcagaagacgaggctagactattctgtacaattcttnagacatcagtggtacttatgtcttcggaacgtcggaaccaggtccaccgtcctacggtcacgacccaacggacccaaaccccnctacgtcctactcttcccg

SEQ ID NO: 322831 - DNA, 536 bp, Homo sapiens
  misc_feature: GZ8MTXP02F0S6X.51.6.A06.1.454.CMB.2.raw
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (327)..(327): a, c, t, g, unknown or other
  misc_feature (327)..(327): n is a, c, g, or t
  modified_base (340)..(340): a, c, t, g, unknown or other
  misc_feature (340)..(340): n is a, c, g, or t
  modified_base (428)..(428): a, c, t, g, unknown or other
  misc_feature (428)..(428): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggacgtcctgagactctcctgtgagcctctggattcagcttcagtacgtatggttgcgngtgggtccnccaggctccgaggcaagggctgcaggtgggtgnatctatatcatanggaaaggaagcaaataaatactaacgcaagactcgtagaagggccgattacacatctccagagacaactccaaagaacactactttanactagacaaaatcgaaacacctagactaacgtcgaacgacaccgggtcttcgtacttacttacgttacgcgacggaaggaacgggacgtacgtacgactacgacgacg

SEQ ID NO: 322832 - DNA, 611 bp, Homo sapiens
  misc_feature: GZ8MTXP02JTNUI.51.6.A06.1.454.CMB.2.raw
  modified_base (364)..(364): a, c, t, g, unknown or other
  misc_feature (364)..(364): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacgccaggatcacctgctctggagatgcattgcccaaacccatattcttattggtaccagcagagccaggccaggcccctgtgttgtgatatataagaccatgagaggccttgagggctcccgtgacgcgtattcnctcggcctccacctcgagggacaagtggtacactattcgaccctatccaggtggacgtcccgaaggccgaaagaacgacggacgggtacttacggtaaccttaagttttcctaggttacctaaaagtttcctttaccgtaaagaacctagttacccgtaaggtttacgggttaaaccttttagttacggtttaccgtttaaccggggtaaaaccgtttacgggggtaaaccctttaaaacccggggg

SEQ ID NO: 322833 - DNA, 533 bp, Homo sapiens
  misc_feature: GZ8MTXP02ILO67.51.6.A06.1.454.CMB.2.raw
  modified_base (362)..(362): a, c, t, g, unknown or other
  misc_feature (362)..(362): n is a, c, g, or t
  modified_base (422)..(422): a, c, t, g, unknown or other
  misc_feature (422)..(422): n is a, c, g, or t
tcagcgatcgtatacacgaccggtgctcgatttagatctactgacaggggctgtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgcccaacccatattcttattggtaccagcagaagccaggcaggcccctgtgttgtgatatataaagcactgagaggcctttcagggactcccctgagcgatttcctctggctccacctcgaagggcaatggtccaactnttgaccatcagtggagtccaggcagaacgacgaggctagacttatttctgtctaatcttnagacatcagtacgtacttatgttctttacggaacgttgggaacctaaagggtcctacccggttacctaaggtaccaaggaccccaaaggccccaaacccgactcgtacacc

SEQ ID NO: 322834 - DNA, 574 bp, Homo sapiens
  misc_feature: GZ8MTXP02J4V7N.51.6.A06.1.454.CMB.2.raw
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
tcagcgatcgtatacacgaccggtgctcgatttagatctactgacaggggtgggtccaggaggcagaactctgggtgtctcaccatggcctggatccctctacttctccccctcctcactctctgcacaggctctgaggcctcctatgtgctgacacagccaccctcggtgtcccgtgtcccccaggacagacggccaggatcacctgctctggagatgcattgacccaacccattattcttattggtaccagcagaagccaggccaggcccctttgttgttgatatataaagacactgagaggccttcagggatccctgagcgattctctggccctccacctcagggacaatggtcacattgaccatcagtgagtccaggcagagacgagggctgactaatttnttntctatacttctagacatctagtgggttacttaattggttcttcggtaaccgtacgggtaccggaacggtacgtacccgtacccgtacggttaccgacgacccgaaccgggaacccgaacccccaaacccctaccgttaccgtaccttccttccgttttccccccgg

SEQ ID NO: 322835 - DNA, 623 bp, Homo sapiens
  misc_feature: GZ8MTXP02HU8I4.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttatggtaccagcagaagccaggccaggccctgtgttgtgatatataaagacactgagaggccttcgagggctcccgtagacgcgtattctcttcgggccttcccacctcgaacggggaaccaaattcgggtacaactaagttacgaccctaattccgaaagttgggaacgttcccgaagggaccgaaggaaagaaccggtaagggccttaaggaacctttaagtttttcccaggtttacccaaaagtttcctttaaccaaaggtaaaccgaacgtactaacgttacgggttaacgtttaacttagttacgtttacggtaaccgtacgggttaaaccgtaaaacccggg

SEQ ID NO: 322836 - DNA, 491 bp, Homo sapiens
  misc_feature: GZ8MTXP02J27Q8.51.6.A06.1.454.CMB.2.raw
  modified_base (326)..(326): a, c, t, g, unknown or other
  misc_feature (326)..(326): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattctattggtacagcagaagccaggccaggcccctgtgtgttgatatataaagacactgagaggacttcagggatccctgagcgattccnctggctccacctcagggcaatggtcacattgaccatcagtggatccaggcagaagcgaggctgactatttctgtcaatcttcagacatcagtggtacttatgtcttcggaacttgggaccaaggtcaccgtctaggtcaagcccaaggccaacccactcgctacc

SEQ ID NO: 322837 - DNA, 486 bp, Homo sapiens
  misc_feature: GZ8MTXP02I1Y79.51.6.A06.1.454.CMB.2.raw
  modified_base (231)..(231): a, c, t, g, unknown or other
  misc_feature (231)..(231): n is a, c, g, or t
  modified_base (349)..(349): a, c, t, g, unknown or other
  misc_feature (349)..(349): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
tcagcgatcgtatacacgaccggtgctcgatttagatctactgacaggggctgtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccnctattcttatgtacagcagagcaggccaggcccctgtgttgtgatatataaagacactgagaggcctttcagggatccctgagcgattcctctggctccactcagggcaatggtcacnttgaccatcagtggagtccaggcagagacgaggctgactattcngtcaatcttanagacatcagtgtacttagtgtcttcggaactggaccaaggtcacgtcctaggtcaagcccaaggcccaaccgactgtactac

SEQ ID NO: 322838 - DNA, 796 bp, Homo sapiens
  misc_feature: GZ8MTXP02G4P6I.51.6.A06.1.454.CMB.2.raw
  modified_base (256)..(256): a, c, t, g, unknown or other
  misc_feature (256)..(256): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggtttcctcgttgctcttttaagaggtgtccagtgtcaggtgcagctggtgcagtcgtgggggaggcgtggtccagcctgggaggtccctgagactctcctgtgagcctntggattcagcttcagttacgtagttggtttgccgtcgttgggtccccgccgtagggcctacccgaagggccgaaaagggggccttgggcctaaggggtggggtcggacctaaagttcctaatactaccgtaattaagtaggaaaacgggaaagacctaaaagttaaaaaacttaaccgtaaaccggaccaaacggtaacccgttacccgggttaagggaaaacgggggcccccggtaaatttacccgaaacccgtaaacgttcccttaccccgaaagtaaaccggaaacccaaaaaccgttaccccccaaaaaagggtaaaccccaaaccttaaaacccgttttttaaactacccgttaacgaaaaccctaaaacgttaaccggaaaaccccttaaccccgtaggtaaaccggtaaccgttaacgggaaaccggtaaccgtaaccggtacctttacgttaacgtttaacgtttaacgtttacggtacggacggtaagggtaacgggaacggttacgtacggtaactaaccgtaacgaacg

SEQ ID NO: 322839 - DNA, 527 bp, Homo sapiens
  misc_feature: GZ8MTXP02H6R51.51.6.A06.1.454.CMB.2.raw
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (370)..(370): a, c, t, g, unknown or other
  misc_feature (370)..(370): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttccgtcgttaggctcttttaagaggtgtccagtgtcaggtgcagctggtgcagtcgtggggggagcgtggtccagccgtgggaggtccctgagactctcctgtgaacgcctctggattcagcttcagtacgtatggtttncgctggggtcccnccgtagggctccgaggcgaaaggggctggctaggtgggtggcatctatatcatatggaaaggaaanctaaataaactacgacgacagactcgagacggctatcacatccacagacacactaccaanaacactacttanacagacaanacacacacgacgtagtagacgacgacgtctcgtatattagtcgtgagaaggaggacgacgtacgactacgacgacg

SEQ ID NO: 322840 - DNA, 544 bp, Homo sapiens
  misc_feature: GZ8MTXP02GJVHN.51.6.A06.1.454.CMB.2.raw
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (260)..(262): a, c, t, g, unknown or other
  misc_feature (260)..(262): n is a, c, g, or t
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggtttcgcgttaggctctttaagaggtgtccagtgtcaggtgcagctggtgcaggtctgggggagcgtggtccagcctgggagtccctgagctctctgtgagccctntaggntnnntntagtagtgtgtgcgcgtcggtcgcgcgcncgagacgaggcgngngnggtggtgntntntactatatatagtagaagaagataaataaactactacgacacgtacgtacgtacgacggaccgtactacactactactacacgacgaacaacaaccaaacaactaactacttactactacaacaacaacaactacgtacgtacgtacgtacgacgacgacgtacgtacgtacttacgtacgttacgtagagaaggaggacgtacgtacgtactacgacgacg

SEQ ID NO: 322841 - DNA, 533 bp, Homo sapiens
  misc_feature: GZ8MTXP02F04Q1.51.6.A06.1.454.CMB.2.raw
  modified_base (408)..(408): a, c, t, g, unknown or other
  misc_feature (408)..(408): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccatattcttattggtaccagcagaagccaggccaggcccctgtgttgtgatatataaagacactgagaggccttcagggatccctgagcgattctctggctccactcagggacaatggtcacattcgaccatcagtgagtccaggcagaagacgagctagacttattctgtcaattcttnagacatcagtgtacttatcgttacgttacggaacttacgggaacctaagggttccaaccgttccgtacgtacgacgaccccaaacggaccccaaaccccgtactcgtaccaccgttctttcccgg

SEQ ID NO: 322842 - DNA, 547 bp, Homo sapiens
  misc_feature: GZ8MTXP02F5NF9.51.6.A06.1.454.CMB.2.raw
  modified_base (295)..(295): a, c, t, g, unknown or other
  misc_feature (295)..(295): n is a, c, g, or t
  modified_base (348)..(348): a, c, t, g, unknown or other
  misc_feature (348)..(348): n is a, c, g, or t
  modified_base (425)..(425): a, c, t, g, unknown or other
  misc_feature (425)..(425): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgaagcctctggattcagcttcagtacgtatggtttgcgctggggtccncaggctccaggcaaggggctgcaggtgggtgcatcatatcatatgaaaggaancaaataaatactacgacaagactcgagaacggcctatcactatcacagacaacaactaccaaagaacaactacttanactagaacaaatacgaaaccaccgtagaacgtacgtaggaacggaccgacggtctacgtacttaagtttacgttcggtacggacggaagggaagggaacgtacgtacgtaactacgacgacg

SEQ ID NO: 322843 - DNA, 652 bp, Homo sapiens
  misc_feature: GZ8MTXP02HB8HB.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaacccacttattcttattggtaccagcagaagccaggccaggcccctgtcgttgttgatataataaagacactgagacggtccttcgagggtactcccgtgacgacgtattcgtctcggcctccacctcgagggacaagtcggtacactattacgacctatcaggtgacgtccgaggacaaggaagacgacgggctaggacttatttccgtagtactaaattccttacgacgtactattacgtaggttacggtttaacttaagttcggttaccgtttaacgggtaaacgttacgggggtaaacccgtaaacggggttaccctaacccgggttacccggttaacgggttacccgaaccggaaccccgaaaccgggacccccaaaacccccgtacgtccggtaccaaccctttcccgtttccccgg

SEQ ID NO: 322844 - DNA, 533 bp, Homo sapiens
  misc_feature: GZ8MTXP02HM9LG.51.6.A06.1.454.CMB.2.raw
  modified_base (397)..(397): a, c, t, g, unknown or other
  misc_feature (397)..(397): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgcattcgccaacccactattcttatggtaccagcagagccagccaggcccctgtgttgtgatataataaagacactgagagtccttacgagggactccctgacgcgtattctctgctccacctcgagggacaatcggtcanattgaccatacagtggagtaccgaggacaagaagacgaggctagacttagttctagtacaattccttacaagaactataccgtagttacggttaactttatcgttacgttacggtaacgtcgggtaaactaaccgg

SEQ ID NO: 322845 - DNA, 603 bp, Homo sapiens
  misc_feature: GZ8MTXP02IVU86.51.6.A06.1.454.CMB.2.raw
  modified_base (254)..(254): a, c, t, g, unknown or other
  misc_feature (254)..(254): n is a, c, g, or t
  modified_base (282)..(282): a, c, t, g, unknown or other
  misc_feature (282)..(282): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccactattcttattggtaccagcagacncgacgcacgccctgtgttgtgatataanaaagacacgtagagacgtccttaggagggtactccgtgacgacgtattccgtcgtccggcctaccacctcggaacgggaactaagttcgggtacaactagttcgaacctatacgtaaggtggacgttacccgaggacgaaaggaaacggacggagggtacctaggtaactttagtttacttacgtactaaacttctttacgaacgactaatcgtaggttacgttattagttgttacgttacgaacgtacggaactaacggtcctaaccgtcgtacggtacacgaccgaacgacccaaaccctcgtctacacttcgttcccc

SEQ ID NO: 322846 - DNA, 492 bp, Homo sapiens
  misc_feature: GZ8MTXP02JU7AE.51.6.A06.1.454.CMB.2.raw
  modified_base (398)..(398): a, c, t, g, unknown or other
  misc_feature (398)..(398): n is a, c, g, or t
  modified_base (427)..(427): a, c, t, g, unknown or other
  misc_feature (427)..(427): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcagggatccctgagcgattctctggctccactcagggacaatggtcacattgaccatcagtgagtccaggcagaagacgaggctgactatttcngtcaaatcttcagacatcagtggtactangtcttgaactgggaccaaggtcaccgtctagtcacgccaaggccaaccccatcgtacactctccg

SEQ ID NO: 322847 - DNA, 507 bp, Homo sapiens
  misc_feature: GZ8MTXP02JO1JJ.51.6.A06.1.454.CMB.2.raw
  modified_base (306)..(306): a, c, t, g, unknown or other
  misc_feature (306)..(306): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcgacctgctctggagatgcattgccaaccactattcttattggtaccagcagaagccaggccaggcccctgtgttgttgatatataaagacactgagaggccttnagggatccctgagcgattctctcggctccacctcagggacaatggtcacattgaccatcagtggagtccgaggcaggaagacgagggctagacttattctgtcaattcttcagtacatcagtggtacttatgttctcggaactgggaaccaaagtccacgtctacggtcacgcccaaggccaacccactcgcaactctccg

SEQ ID NO: 322848 - DNA, 508 bp, Homo sapiens
  misc_feature: GZ8MTXP02GN5XJ.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccacctcggtgtccgtgtccccaggacagacggccaggatcacctgctctggagatgcattgccaacccactattctatggtaccagcagagccaggccaggcccctgtgttgttgatataataaagaccactgagaggccttcgagggatccctgacgcgattctctggcctccacctcaagggacaagtggcacattgaccatcgagtggagtccgaggcagaagacgaggctagactagtttctgtcaattcttacagactatacagttggtaacttagtgtactttacggaactcgggactaacgg

SEQ ID NO: 322849 - DNA, 507 bp, Homo sapiens
  misc_feature: GZ8MTXP02F3ER2.51.6.A06.1.454.CMB.2.raw
  modified_base (351)..(351): a, c, t, g, unknown or other
  misc_feature (351)..(351): n is a, c, g, or t
  modified_base (408)..(408): a, c, t, g, unknown or other
  misc_feature (408)..(408): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaaccactattcttattggtaccagcagaagccaggccaggcccctgtgttgtgatatataaagacactgagaggccttcgagggatccctgagcgattctctcgctccactcaggacatggtcanattgaccatcagtgagtccagcaagaagacgaggctagactattctgtcaaatcttnagacatcagttggtacttatgtacttcggaactcggaccaaaggtccaccgtctacggtacacgacccaaggcccaacccactcgtcaccgtcttcccg

SEQ ID NO: 322850 - DNA, 507 bp, Homo sapiens
  misc_feature: GZ8MTXP02HMQXB.51.6.A06.1.454.CMB.2.raw
  modified_base (294)..(294): a, c, t, g, unknown or other
  misc_feature (294)..(294): n is a, c, g, or t
  modified_base (424)..(424): a, c, t, g, unknown or other
  misc_feature (424)..(424): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgaagcctctggattcagcttcagtacgtatggtttgcgctgggtccnccaggctccgaggcaagggactgcaggtgggtgcagtctatatcatatggaagaagcaaataaatactacgcagactcgagaaggccatcacatctaccagagacaatacccaaagaacactacgtttanctagacaaatcgaacacctagacgactagagtacacggtctcgtcttattagtgtgacgaagaggacacgtagactcacgacg

SEQ ID NO: 322851 - DNA, 499 bp, Homo sapiens
  misc_feature: GZ8MTXP02HAM56.51.6.A06.1.454.CMB.2.raw
tcagcgatcgtatacacgaccggtgctcgatttagatctactgacaggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctcggctccactcagggacaatggtcacattgaccatcagtgagtccaggcagaagacgaggctgactatttctgtctaatcttacagacatcagtgtacttatgtcttcggaactgggaccaaggtcacgtctaggtcagcccaaggcccaacccgactcgtaccactctccg

SEQ ID NO: 322852 - DNA, 619 bp, Homo sapiens
  misc_feature: GZ8MTXP02F8GVJ.51.6.A06.1.454.CMB.2.raw
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
  modified_base (477)..(477): a, c, t, g, unknown or other
  misc_feature (477)..(477): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagccgtgggagtccctgagctctcctgtgaagcctntggattcagtcttcagtacgtatggttgcgcgtggggtccnccgaggcctccgaggcgaaggggctggcaggtgggtgcattctatatcaatagtaggaaaggaagcaaaataaaactacgtacgcaaagaccgtacccggtaggaaacggggtccctaattacccaaccctattccacccaaggaacaacaaactaccccaaaagaacctactaactttancctagaacaaaactcgaaacctacccgtagaacgtacttaggaacggaaccgtacggtcttacggttactaacgttttaacgtcggttacggacgggaaggtaagggggaactacggttacggaacttaccgaacgaaccgg

SEQ ID NO: 322853 - DNA, 483 bp, Homo sapiens
  misc_feature: GZ8MTXP02FYEI1.51.6.A06.1.454.CMB.2.raw
  modified_base (229)..(229): a, c, t, g, unknown or other
  misc_feature (229)..(229): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccntattcttattggtaccagcagaagccagccaggcccctgtgttgttgatatataaagacactgagaggccttcaggatccctgagcgattctctggctccactcaggacaatggtcacattgaccatcagtgagtccaggcagaagacgaggctgactattctgtcaatcttcagtacatcagtgtacttatgtcttggaactgggaccaaggtcacgtctaggtcagcccaagccaaccncngtcactctccg

SEQ ID NO: 322854 - DNA, 494 bp, Homo sapiens
  misc_feature: GZ8MTXP02GYPZY.51.6.A06.1.454.CMB.2.raw
  modified_base (324)..(324): a, c, t, g, unknown or other
  misc_feature (324)..(324): n is a, c, g, or t
  modified_base (423)..(423): a, c, t, g, unknown or other
  misc_feature (423)..(423): n is a, c, g, or t
tcagcgatcgtatacacgaccggtgctcgatttagatctactgacagggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggctgcagtgggngcatctatatcatatgaaggaagcaaataaatactacgcagactccgtagaagggccgattcaccatctccagagacaatcccaaagaacacactttanctagacaaatgaacacctgagacttgagacacggctgtctattatgtgacgaagaggagatcgatcacacg

SEQ ID NO: 322855 - DNA, 615 bp, Homo sapiens
  misc_feature: GZ8MTXP02IHT5L.51.6.A06.1.454.CMB.2.raw
  modified_base (367)..(367): a, c, t, g, unknown or other
  misc_feature (367)..(367): n is a, c, g, or t
  modified_base (477)..(477): a, c, t, g, unknown or other
  misc_feature (477)..(477): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtgcagtcgtgggggaggcgtggtccagccgtgggaggtccctgagactctcctgtgaagcctctggattcagtcttcagtacgtagtggttgcgtcgtgggtcccgcgaggcctccgaggcaaaggggctggcgaggtgggtgcagtctatatcatagtaggaaaggaancaaattaaaataccgtaacgcaagacctccgtagaacgggcctaattccaactatcctacccaagaacgaacctaaactacccaaaagtaaaccaacttaaccttttaanaccttagaacctaaaatcgaaaaccacccgtaggaacgtaaccgttaggacggtaaccgacgggtaccttaggttacttaagtttacgttggtacgacgggtaaggagggacgtacgtacggtactaccgaacgacgg

SEQ ID NO: 322856 - DNA, 624 bp, Homo sapiens
  misc_feature: GZ8MTXP02G2V3X.51.6.A06.1.454.CMB.2.raw
  modified_base (258)..(258): a, c, t, g, unknown or other
  misc_feature (258)..(258): n is a, c, g, or t
  modified_base (364)..(364): a, c, t, g, unknown or other
  misc_feature (364)..(364): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggtttcctcgttgctctttaagaggtgtccagtgtcaggtgcagctggtgcaggtcgtgggggagcgtggtccagccgtgggagtccctgagactctcctgtgaagtccctntggattcagtcttcagtacgtagtggttgcgcgtgggtccgccaggctccgaggcgaagggctgcgaggtgggtggcaagtctaatatacaatagtagaaaggaanactaaaataaactactacgacaacgtaccgtacggaggaacggacctataccaactacgtcaccagaacaacaacctaacccaaagaacctaacttaactttacgactacgaaactaaacgtaaccgaaaccctaccgtagaacgtaacgtacggaacggtaaccgtacggtacttacgttacttaaagtttacgttacgtaacggaacggtaaggggtaacgggtacggtaacgtaccggtactaaccgtaacgtaacg

SEQ ID NO: 322857 - DNA, 512 bp, Homo sapiens
  misc_feature: GZ8MTXP02HKPS3.51.6.A06.1.454.CMB.2.raw
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
  modified_base (471)..(471): a, c, t, g, unknown or other
  misc_feature (471)..(471): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggtttgcgctggggtccnccaggcctccgaggcaaggggctgcaggtgggtgcatctatatcatatgaaaggaanctaaataaatctacgcagactccgagaaggccgatcaccatctccagagacacacccaaagacanactttanctagaccaaatcgaaacaccctagacgtacgtgaacggtacacggntcgtactattatcgtgagaaggngganagtgactcaacacg

SEQ ID NO: 322858 - DNA, 515 bp, Homo sapiens
  misc_feature: GZ8MTXP02F673A.51.6.A06.1.454.CMB.2.raw
  modified_base (254)..(254): a, c, t, g, unknown or other
  misc_feature (254)..(254): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
tcagcgatcgtatacacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaaccactattcttatggtacagcagancagcaggccctgtgttgtgatatataaagacactgagaggtccttcgagggactccctgagcgattccctcgtgctccacctcaagggacaatggtacacattgaccatcagtggatccaggacagaagagagctagactattcngtcaatcttnagacatcagtgtacttatgtcttacgaacgtggaacctaaaggtccaaccgttaccgtaggtacaacgacccgaaacggacccaaacccctacttcgactaacccg

SEQ ID NO: 322859 - DNA, 519 bp, Homo sapiens
  misc_feature: GZ8MTXP02FQNXC.51.6.A06.1.454.CMB.2.raw
  modified_base (231)..(231): a, c, t, g, unknown or other
  misc_feature (231)..(231): n is a, c, g, or t
  modified_base (411)..(411): a, c, t, g, unknown or other
  misc_feature (411)..(411): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccntattcttatggtaccagcagaagccaggccaggcccctgtgttgttgatatataaagacactgagaggccttcgagggatccctgagcgattctctcggcctccacctcgaggacaatggtcacattgaccatcagtgagtccaggcagaagacgaggctgactattctgtcaaatctanagacatcagtgtacttagtgtacgttcggaactcgggaacctaaagggtcaacccgttcctacggtcacgacccaacggcccaaacccgactcgtccactcgttcccg

SEQ ID NO: 322860 - DNA, 545 bp, Homo sapiens
  misc_feature: GZ8MTXP02JX8W7.51.6.A06.1.454.CMB.2.raw
  modified_base (294)..(294): a, c, t, g, unknown or other
  misc_feature (294)..(294): n is a, c, g, or t
  modified_base (368)..(368): a, c, t, g, unknown or other
  misc_feature (368)..(368): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggttgcgctgggtccncaggctccgaggcaaggggactgcaggtggggtgcagtctatatcatatggaaggaagcaaataaatactacgnacgactcgtagaaggccgatcacatctccagacgacaactacccaaagacactacttatactagacaaatacgaacacctagagtaccttagaacggtacacggtctacggttacttaagttacgttcggttacggacggaaggtaggggaagtacgtacggacttacgaacaacgg

SEQ ID NO: 322861 - DNA, 549 bp, Homo sapiens
  misc_feature: GZ8MTXP02FNQDN.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagaggccttcgagggactccctgagcgattctctcggctccacctcgagggaccaaagtcgggtcacgatttcgaccatcagtggagtcccaggacaggaagacgaggctagactatttctgtactaattcttacagaccatcaggttggttacttagtgttcgttcggaactcgggacccaaggtaccaccggttcgtacgggtacacgacccgaacggacccaaaccccgactcgtaccaccttcttacccg

SEQ ID NO: 322862 - DNA, 502 bp, Homo sapiens
  misc_feature: GZ8MTXP02I4Q4U.51.6.A06.1.454.CMB.2.raw
  modified_base (293)..(293): a, c, t, g, unknown or other
  misc_feature (293)..(293): n is a, c, g, or t
  modified_base (415)..(415): a, c, t, g, unknown or other
  misc_feature (415)..(415): n is a, c, g, or t
  modified_base (439)..(439): a, c, t, g, unknown or other
  misc_feature (439)..(439): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgaagcctctggattcagcttcagtacgtatggttgcgctgggtccncaggctccgaggcaagggctgcaggtgggtgcatctatatcatatgaaaggagcaaataaatactacgcagactcgagaacggcatcacatctcagagacatcccaaagaacactactttanctagacaaatcgaacaccctaganacttgaaggacacggctagtacttattacgttgtcgacgaaggagggatagtcgatcacgacg

SEQ ID NO: 322863 - DNA, 524 bp, Homo sapiens
  misc_feature: GZ8MTXP02I4UAY.51.6.A06.1.454.CMB.2.raw
  modified_base (245)..(245): a, c, t, g, unknown or other
  misc_feature (245)..(245): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (363)..(363): a, c, t, g, unknown or other
  misc_feature (363)..(363): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctccngtgaagcctctggattcagcttcagtacgtatggttncgctgggtccncgaggctccaggcaagggactgcgaggtgggtggcatctatatcatatgaagagcaaataaatactacgnagactccgtgaagggccgatcacatctccagagacaactcccaaagaacactaactttactctagacaaagtcgaaaccaccctagagacttagacggacaacggtctaggtacttaattagttggtcgaggaaggagggagactacgaactcgaacgacg

SEQ ID NO: 322864 - DNA, 492 bp, Homo sapiens
  misc_feature: GZ8MTXP02GYUFR.51.6.A06.1.454.CMB.2.raw
  modified_base (295)..(295): a, c, t, g, unknown or other
  misc_feature (295)..(295): n is a, c, g, or t
  modified_base (422)..(422): a, c, t, g, unknown or other
  misc_feature (422)..(422): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggtttgcgctgggtccnccaggctccaggcaaggggctgcagtgggtgcatctatatcatatgaaaggaagcaaataaaatctacgcagactccgtgaaaggccgatcacatctccagagacaatcccaaagaacacactttanctagcaaaatgaacaccctgagactgagacacggctgtctattatgtgcgaagaggagatcgatcgacag

SEQ ID NO: 322865 - DNA, 497 bp, Homo sapiens
  misc_feature: GZ8MTXP02IS6TG.51.6.A06.1.454.CMB.2.raw
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
  modified_base (346)..(346): a, c, t, g, unknown or other
  misc_feature (346)..(346): n is a, c, g, or t
  modified_base (386)..(386): a, c, t, g, unknown or other
  misc_feature (386)..(386): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccaggcctgggaggtccctgagactctcngtgagctngatcagcttcagtacgtatggttncgcgtgggtcccncgaggcctccaggcaagggctgcaggtgggtgcatctatatcatatgaaaggancaaataaactactacgcagactcgagaggccatcacatcnccagacgacacaccaaagacactacttanctagacaatgaaccncctaganactagagacngctgtactattacgtagtgagaaggtaggacgtatcggactacgacgacg

SEQ ID NO: 322866 - DNA, 595 bp, Homo sapiens
  misc_feature: GZ8MTXP02HBEMW.51.6.A06.1.454.CMB.2.raw
  modified_base (356)..(356): a, c, t, g, unknown or other
  misc_feature (356)..(356): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgtgatatataaagacactgagaggccttcgagggatccctgacgcgtattctctcggcctccactcgaggacaatggtcanattgaccatcagtgatccaggcagaagacgaggctgaacttatttctagttactaaacttctttacaagtaccattcgagttacggttactttaagtgtttaccgttacggaacgttacgggaaccgtaacggttacccgaacccggttcctaacggggttaccctaacggacccccgaaaccgggtacccccaaaacccccgtacgttacgtaccctaacccgttactttccccccgg

SEQ ID NO: 322867 - DNA, 540 bp, Homo sapiens
  misc_feature: GZ8MTXP02J1SZL.51.6.A06.1.454.CMB.2.raw
  modified_base (130)..(130): a, c, t, g, unknown or other
  misc_feature (130)..(130): n is a, c, g, or t
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacnggctctgaggcctcctatgtgctgacacagccaccctcggtgtccgtgtccccaggcagacggccaggatcacctgctctggagatgcattgccaacccactattcttattggaccagcnagccagccaggcccctgtgtgttgntatataagacactgagaggccttcagggatccctgagcgattctctcggctccacctcagggacaatggtacacnttgaccntcagtggagtccgaggcagaaagacgaagggctaggactattttctgtctaaattcttacagacatcagtggttacttagtgttacgtttcgaaaacgttggggaccaaagggtcctaacccggtccttacgggttccacgcccaaaggccccaaacccctactcgtcctactcgtttcccgg

SEQ ID NO: 322868 - DNA, 554 bp, Homo sapiens
  misc_feature: GZ8MTXP02J11CC.51.6.A06.1.454.CMB.2.raw
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatcacctgctctggagatgcattgccaacccactattcttatggtaccagcagaagcaggccaggcccctgtgttgttgatatataaagaccactgagagcttcgagggntccctgacgngattctctggctccacctcgagggaccaagtggtcacgtaattgaccctatccgaagttgggaacgtcccgagggccgaaggaacgacggagggacctaggaccttaatttcgtggttactaaacttcttaccagtacctatccgaagttacggtaaccttaagttgttcgttacggaacttcggggaacctaacggg

SEQ ID NO: 322869 - DNA, 622 bp, Homo sapiens
  misc_feature: GZ8MTXP02H8GDU.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttggatataataagacactagagacgtctcggaggctcccgtagacggcgtacttctcgtcggtccctacccacctcggaggaaccaagttcggtaccaacttagttaccgacctactaccgtaggtcgggtacgttaccgacggacgaaaggaaacggaacgggacggtacgtacggtaactttaacttttcgttacgttaactaaacgtttcctttacgaacgactactaccgttagttacggtttaaacctttgttacgtttaccgtttacggtaaccggttacggtaaacccgttaaacccggg

SEQ ID NO: 322870 - DNA, 494 bp, Homo sapiens
  misc_feature: GZ8MTXP02JP259.51.6.A06.1.454.CMB.2.raw
  modified_base (401)..(401): a, c, t, g, unknown or other
  misc_feature (401)..(401): n is a, c, g, or t
  modified_base (481)..(481): a, c, t, g, unknown or other
  misc_feature (481)..(481): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcgagggatccctgagcgattctctcggcctccacctcagggacaatggtcacattgaccatcagtgatccaggcagaagacgaggctgactatttcngtcaatcttacagacatcagtggtacttatgtcttggaactggacaggtcaccgtctagtcacgcccaaggcccaacccnctcgcactctccg

SEQ ID NO: 322871 - DNA, 544 bp, Homo sapiens
  misc_feature: GZ8MTXP02JRU23.51.6.A06.1.454.CMB.2.raw
  modified_base (354)..(354): a, c, t, g, unknown or other
  misc_feature (354)..(354): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcagggatccctgagcgattctctcggctccacctcagggacaatggtcanattgaccatcagtgagtccaggcagaagacgaggctagactatttctgtcaatcttcagacatcgagtcggtacttagtgttcgttacgaacgttgggaacctaaggggttccacccggttcccttagggtcccaacggccccgaaaagggccccaaaacccccgcttacggtccaaccttcttccccgg

SEQ ID NO: 322872 - DNA, 648 bp, Homo sapiens
  misc_feature: GZ8MTXP02HH4QD.51.6.A06.1.454.CMB.2.raw
  modified_base (370)..(370): a, c, t, g, unknown or other
  misc_feature (370)..(370): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagccctcgtggattcagtcttcagttacgtagttggtttgcgcgtgggtcccgcgaggcctaccgaggcgaagggctgcgaggtggggtgctagtctatactcatagtaggaaagggaanactaaaattaaaatacctaacgacaacggaacccgttcccgggtagggaaacgggggacccgtaatttacccgaaccctaacgttccctacccgaaaggaaccgaaacaaacctaccccgaaaagaaaccctaaccttaactttttacacgttacgaaacctaaaattacgaaaaccctacccgttaggaacgtaccgttaggaacggtaaccgacgggtcttacgttcttaatttacgtgtcggagaaggaagggagtagtacggactacaacgacg

SEQ ID NO: 322873 - DNA, 505 bp, Homo sapiens
  misc_feature: GZ8MTXP02HOOPM.51.6.A06.1.454.CMB.2.raw
  modified_base (256)..(256): a, c, t, g, unknown or other
  misc_feature (256)..(256): n is a, c, g, or t
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggtttcgtcgttaggctctttaagaggtgtccagtgtcaggtgcagctggtgcagtctgggggagcgtggtccagcctgggaggtccctgagctctcctgtgaagccctntgggattcagcttcagtacgtatgttgcgctggtcgcagctccagcgaggacgtgcgagtgggtgggcatctatatnatatgaggaaganaaataaatacacgacacgacgtacgtagacggacgactacacactcacagacacacacaacaacactacttatananacaacacacactacgagtacgtagacgacgacgacgtacgtacttacttacgtgtgagaaggaggagtagacgacacacacg

SEQ ID NO: 322874 - DNA, 543 bp, Homo sapiens
  misc_feature: GZ8MTXP02II4J4.51.6.A06.1.454.CMB.2.raw
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
  modified_base (401)..(401): a, c, t, g, unknown or other
  misc_feature (401)..(401): n is a, c, g, or t
  modified_base (431)..(431): a, c, t, g, unknown or other
  misc_feature (431)..(431): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggagtccctgagactctcctgtgaagcctctggattcagcttcagtacgtatggttgcgctgggtccnccaggctccgaggcaagggactgcagtgggngcatctatatcatatggaaagaagcaaataaaatactacgacagactcgagaaagggccattccaccatcacaganaacactacccaaagaaccacaacttttaanctagaactaaaagtacaaacctacctagaaagtacgtagaacggactaacggtctacgttacttaattacgttcgtacgacggaaggacgggatacgtacgactacaacgcg

SEQ ID NO: 322875 - DNA, 488 bp, Homo sapiens
  misc_feature: GZ8MTXP02G6G15.51.6.A06.1.454.CMB.2.raw
  modified_base (139)..(139): a, c, t, g, unknown or other
  misc_feature (139)..(139): n is a, c, g, or t
  modified_base (209)..(209): a, c, t, g, unknown or other
  misc_feature (209)..(209): n is a, c, g, or t
  modified_base (342)..(342): a, c, t, g, unknown or other
  misc_feature (342)..(342): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctntacttctccccctcctcactctctgcacaggctctgaggcctcctatgtgctgacacagcccacctggtntccgtgtccccaggacagacggcaggatcacctgctctggagatgcattcgcccaaacccactattcttattggtaccagcagaagccaggccaggcccctgtgttgtgatatataaagacactgagagcttnagggctcctgagcgattcnctagctcacctnaggacaagtgcacatgacananagngagacgagagaagaagagagagatatacttctntactatactacanacactactagtagtaagtatacgtcgtacgtacgtacgacgacg

SEQ ID NO: 322876 - DNA, 488 bp, Homo sapiens
  misc_feature: GZ8MTXP02JVU0A.51.6.A06.1.454.CMB.2.raw
  modified_base (305)..(305): a, c, t, g, unknown or other
  misc_feature (305)..(305): n is a, c, g, or t
  modified_base (411)..(411): a, c, t, g, unknown or other
  misc_feature (411)..(411): n is a, c, g, or t
  modified_base (475)..(475): a, c, t, g, unknown or other
  misc_feature (475)..(475): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagaggccttnagggatccctgagcgattctctcggctccacctcagggacaagtggtcacattgaccatcagtggatccaggcagaagacgaggctagactattctgtcaatcttnagcatcagtgtactatgtcttgactggacaggtcaccgtctaggcagcccaaggcccaaacccnctcgcactctccg

SEQ ID NO: 322877 - DNA, 504 bp, Homo sapiens
  misc_feature: GZ8MTXP02IP1W2.51.6.A06.1.454.CMB.2.raw
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (425)..(425): a, c, t, g, unknown or other
  misc_feature (425)..(425): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagcccaggccaggcccctgtgttgttgatatataaaagacactgagaggccttcagggatccctgagcgatctctggctccactcagggacaaatggtcacattgaccatcagtgagccagnagaagagagntgatattntntcaatacttanananatanagtagtatatntactacgaacgtacggacgaacgtacgaccgtacgtacgtacgacgaccgaaccgaccaacccactactacactactcg

SEQ ID NO: 322878 - DNA, 507 bp, Homo sapiens
  misc_feature: GZ8MTXP02FOQC8.51.6.A06.1.454.CMB.2.raw
  modified_base (410)..(410): a, c, t, g, unknown or other
  misc_feature (410)..(410): n is a, c, g, or t
  modified_base (490)..(490): a, c, t, g, unknown or other
  misc_feature (490)..(490): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccatattcttattggtaccagcagaagccaggccaggcccctgtgttgttgatatataaagacactgagaggccttcgagggatccctgagcgattctctcggctccactcaggacaatgtcacattgaccatcagtgagtccaggcagaagacgaggctagactagttctgtcaatctanagacatcagttggtacttatgtacttcggaacgtcggaccaaggtcaccgtctacggtcagcccgaacggcccaaacccnctcgaccactctacccg

SEQ ID NO: 322879 - DNA, 627 bp, Homo sapiens
  misc_feature: GZ8MTXP02H2T1U.51.6.A06.1.454.CMB.2.raw
  modified_base (308)..(308): a, c, t, g, unknown or other
  misc_feature (308)..(308): n is a, c, g, or t
  modified_base (374)..(374): a, c, t, g, unknown or other
  misc_feature (374)..(374): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagactctcctgtgaacgcctcgtggattcagtcttacagttacgtattgggtttgccgtcgtggggtcccnccgaggcctccgaggcgaaaggggctggcgtaggtgggtgcatctatatcatagtaggaaaggaanctaaataaaactacctacgactaagaccttacccggtaggaaacgggcccgtaattccaacctattcctaccgaagaacgaaacaactacccaaaagtaaacctaacttaactttacacctagaaccaaaagtcgaaacctacccgtagaacgtacgtaggaacggtaccacggtcttagttacttaagtttacgttcggtaggacggtaaagggaggggtaaacgtacgtaccggtaactccgaaacgacgg

SEQ ID NO: 322880 - DNA, 494 bp, Homo sapiens
  misc_feature: GZ8MTXP02GIQ91.51.6.A06.1.454.CMB.2.raw
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (419)..(419): a, c, t, g, unknown or other
  misc_feature (419)..(419): n is a, c, g, or t
  modified_base (440)..(440): a, c, t, g, unknown or other
  misc_feature (440)..(440): n is a, c, g, or t
  modified_base (469)..(469): a, c, t, g, unknown or other
  misc_feature (469)..(469): n is a, c, g, or t
  modified_base (481)..(481): a, c, t, g, unknown or other
  misc_feature (481)..(481): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttcctcgttagctctttaagaggtgtccagtgtcaggtgcagctggtgcagtctgggggaggcgtggtccagcctgggaggtccctgagctctcctgtgaagcctntggattcagcttcagtacgtatggttgcgcgtgggtccnccaggctccgaggcaaggggctgcaggtgggtgcatctatatcatatgaaggaagcaaataaatactacgcagactcgtagaggccatcacatcncaganacaactccaaagaacacactttanactagacaaatgaacaccctnagactagacgacacggctgtctattgtgngtagaagagganagtcgacacacag

SEQ ID NO: 322881 - DNA, 534 bp, Homo sapiens
  misc_feature: GZ8MTXP02HWFIT.51.6.A06.1.454.CMB.2.raw
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctggggaggtccctgagactctcctgtgaagcctctggattcagcttcagtacgtatggtttgcgtctgggtcccgccaggcctccgaggcaaggggctggcaggtgggngcatctatatcatatgaaaggancaaataaatactacgnagactccgngaaggccatcacatcncaganacaactcccaaagaaccactactttanctagaccaaaatgaaacaccctagaacgtacgttagaacggacacggtactagtacttaatttacgttcgtggacgtaaggaggggagaagtcgaatcgaacacg

SEQ ID NO: 322882 - DNA, 555 bp, Homo sapiens
  misc_feature: GZ8MTXP02JYBDT.51.6.A06.1.454.CMB.2.raw
  modified_base (294)..(294): a, c, t, g, unknown or other
  misc_feature (294)..(294): n is a, c, g, or t
  modified_base (446)..(446): a, c, t, g, unknown or other
  misc_feature (446)..(446): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgaagcctctggattcagcttcagtacgtatggtttgcgctgggtccnccaggctcgaggcaaggggactggcaggtggggtgcagtctatatcatagtgaaaggagcaaataaatacctagacaagacctccggtagaaacgggccgattcaccatctaccagaacgacaactaccccgaaagaaacctactactttanactagacaaatacgaaaccacccgtagaacgtacttaggaacggtacgacggtctcggttacttagttacgttcgtgaggaaggagggacgtagtacgatacgacgacg

SEQ ID NO: 322883 - DNA, 504 bp, Homo sapiens
  misc_feature: GZ8MTXP02GIVJ3.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgtgatatataaagacactgagaggccttcagggatccctgagcgattctctcggctccactcagggacaatggtcacattcgaccatcagtgatccaggcagaagacgaggctgactattctgtcaatcttcagacatcagtgtacttatgtcttacggaactcgggaaccaggtcaccgtctacggtacacgacccaaaggcccaacccactcgtacacctctcccg

SEQ ID NO: 322884 - DNA, 639 bp, Homo sapiens
  misc_feature: GZ8MTXP02I64IP.51.6.A06.1.454.CMB.2.raw
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (498)..(498): a, c, t, g, unknown or other
  misc_feature (498)..(498): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtgcagtcgtgggggaggcgtggtccagcctggggagtccctgagctctctgtgagcctntggattcagtcttcagtacgtatggtttgcgcgtgggtccncgaggctccgaggcaagggctgcnggtgggngcatcatatcatagtaggaaaggaagtcaaaattaaactaccgtaccgacaaggaaccgtttcccggtagggaaacgggggtacccctaagtttacccaaccctaactaccctacccaaggaacgaaaccaaactacccccaaaaagaaaccctaacttaacgtttttanacgttacgaaccaaaacttcgaaacctacccgtagacgtaaccttagggaacggtaccgacgggtaccttcggtacttaacgtttacgtcggttacggacggtaagggaacggggataccgtaggactacgaacgtaacgg

SEQ ID NO: 322885 - DNA, 549 bp, Homo sapiens
  misc_feature: GZ8MTXP02F2J8K.51.6.A06.1.454.CMB.2.raw
  modified_base (295)..(295): a, c, t, g, unknown or other
  misc_feature (295)..(295): n is a, c, g, or t
  modified_base (326)..(326): a, c, t, g, unknown or other
  misc_feature (326)..(326): n is a, c, g, or t
  modified_base (427)..(427): a, c, t, g, unknown or other
  misc_feature (427)..(427): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggtttgcgctgggtccnccaggctccgaggcaagggctgcaggtgggngcatctatatcatatgaagaagcaaataaatactacgcaagactccgtagaaggccatcaccatcctccagacgacaatcccaaagaaacactaactttanctagacaaaatgaaaccacccgtagaagaccgttaggaacggaccacgggctacgttacttaatttacttacggtaggtacggaaggtaaggggaggtactacggaacttacgaacgtaacg

SEQ ID NO: 322886 - DNA, 523 bp, Homo sapiens
  misc_feature: GZ8MTXP02G1LWJ.51.6.A06.1.454.CMB.2.raw
  modified_base (295)..(295): a, c, t, g, unknown or other
  misc_feature (295)..(295): n is a, c, g, or t
  modified_base (435)..(435): a, c, t, g, unknown or other
  misc_feature (435)..(435): n is a, c, g, or t
  modified_base (454)..(454): a, c, t, g, unknown or other
  misc_feature (454)..(454): n is a, c, g, or t
  modified_base (508)..(508): a, c, t, g, unknown or other
  misc_feature (508)..(508): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggtttgcgctgggtccnccaggcctccgaggcaaggggactgcgaggtgggtgcagtctatatcatatgaaggagcaaataaatactacgcaagactccgtagaacgggccgattcaccatcctccagacgacaaactcccaaagaacacactttanctagaccaaatcgaaaccncccgtagacgacttagaggacacggctacgtctattagtcgtgcgaagaggganactcgactacacacg

SEQ ID NO: 322887 - DNA, 617 bp, Homo sapiens
  misc_feature: GZ8MTXP02HD530.51.6.A06.1.454.CMB.2.raw
  modified_base (379)..(379): a, c, t, g, unknown or other
  misc_feature (379)..(379): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgcattcgaccaacccatattcttattggtaccagcagaacgccaggccaggcccctgtgttgtgatatataaagaccactgagacggtccttacgagggtctcccgtaggacgtcgtatttcncgtcggccctcccacccgtacgaacggggaacctaagttcggtaccaacgtacgtttacgaacctagttaccgaggttacggacgttacccgagggaccgaaaggaaacggacggtacgggaccttaggtacctttaagtttcgtagttactaaattccttacgaagtactacgtacgtaggttacggttaaccttagtacgttacgttacggtaacgttcggggaaacctaaccggg

SEQ ID NO: 322888 - DNA, 528 bp, Homo sapiens
  misc_feature: GZ8MTXP02H3F4A.51.6.A06.1.454.CMB.2.raw
  modified_base (306)..(306): a, c, t, g, unknown or other
  misc_feature (306)..(306): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttnagggatccctgagcgattctctggctccactcgagggacaatggtcacattgaccatcagtgagtccgaggcagaagacgaggctgacttattctgtacaattcttcagacatcagtggttacttatgttcgttacggaacgttcgggaacctaagggtcaccggtcgttaggtccacgacccgaacggcccaaaccccgtacgtcgtaccacttcctcccg

SEQ ID NO: 322889 - DNA, 497 bp, Homo sapiens
  misc_feature: GZ8MTXP02JICGI.51.6.A06.1.454.CMB.2.raw
  modified_base (429)..(429): a, c, t, g, unknown or other
  misc_feature (429)..(429): n is a, c, g, or t
  modified_base (485)..(485): a, c, t, g, unknown or other
  misc_feature (485)..(485): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcagggatccctgagcgattctctggctccacctcagggacaatggtcacattgaccatcagtgagtccagcagaagacgaggctgactattctgtcaaatcttcagacaatcaagtggtacttangtcttggaactggaccaaggtcacgtctacggtcagcccaaggcccaaacccactnacactcttaccg

SEQ ID NO: 322890 - DNA, 558 bp, Homo sapiens
  misc_feature: GZ8MTXP02HNW1A.51.6.A06.1.454.CMB.2.raw
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (343)..(343): a, c, t, g, unknown or other
  misc_feature (343)..(343): n is a, c, g, or t
  modified_base (439)..(439): a, c, t, g, unknown or other
  misc_feature (439)..(439): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggaggtccctgagactctcctgtgaagcctntggattcagcttcagtacgtatggtttgcgctgggtccnccgaggcctccgaggcaaggggctgcgaggtgggtggcagtctatancatatggaaacggaagcaaataaatactacgcaagactcgagaaggccgattcacatcaccagacgacaactacccaaagaaccactaacttttanctagacaaatcgaaaccaccctagaacgtacgttagaacggaccaacggtcttacgttacttaagtttacgttcggttggacggaaggaggggaacgtagtacggactacgaacgacgg

SEQ ID NO: 322891 - DNA, 568 bp, Homo sapiens
  misc_feature: GZ8MTXP02H1EAU.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatatttcttatggtaccagcagagcaggcaggccctgtgttgtgatatataaagacactgagaggccttacgagggtactcccgtgagcgtattctctcggcctccactcgaggacaatgtcacattgaccatcagtgagtccgaggcaaggaaagacgaaggctagacttattctgtacctaatcttcagacatcagtgttacttatgttcgttacggaacttcgggaacctaacgggtacctaacccggtaccgttaaacgggtccaaaccggaccccgaaaccggggaccccaaaaccccctacgtaccgtaccctaccgttccgtttcccccgg

SEQ ID NO: 322892 - DNA, 587 bp, Homo sapiens
  misc_feature: GZ8MTXP02H88Q8.51.6.A06.1.454.CMB.2.raw
  modified_base (484)..(484): a, c, t, g, unknown or other
  misc_feature (484)..(484): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgaagccctctggattcagtcttcaggttacgtagttggtttgcgtcgtggggtcccgccgaggcctccgaggccaaaggggctggcgaggtgggtggccagtctatatcaatagtggaaaggaagcaaaattaaaatactaacgcaagaccttcccgtagaacggggcccgtaattccaaccctacttccctaccgaagaacgaaccaactacccaaaagaaccaactacttttanctagactaaagtacgaaacctcccgtagacgtacgttagaacggacgacggtctagttacttaattacgttgtgagaaggaggagactacgatacgaacgacg

SEQ ID NO: 322893 - DNA, 553 bp, Homo sapiens
  misc_feature: GZ8MTXP02I4ZRM.51.6.A06.1.454.CMB.2.raw
  modified_base (300)..(300): a, c, t, g, unknown or other
  misc_feature (300)..(300): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggaggtccctgagctctcctgtgaagcctctggattcagcttcagtacgtatggtttgcgcgtggggtcccnccgaggcctccgaggcgaaggggactgcgaggtggggtgcatctatatcatatgaaaggaagcaaataaatactacgacagactccgagaagggcccgattcacattacacccagacgaacaaactacccaaaagaaccaactactttaactactagaacaaactacgaaaccaccctagactacgtagaggtaccacggtactgttactagttagttcgagtacggaagagggacagtcgaacacgacgacg

SEQ ID NO: 322894 - DNA, 684 bp, Homo sapiens
  misc_feature: GZ8MTXP02H9DHA.51.6.A06.1.454.CMB.2.raw
  modified_base (288)..(288): a, c, t, g, unknown or other
  misc_feature (288)..(288): n is a, c, g, or t
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagccaccctcggtgtccgtgtcccaggacagacggccaggatcacctgctctggagatgcattgacccaaccctactatttcttattggtaccagcagaagccaggccaggcccctgtgtgtgatatanaagacactgagaggccttgaggtatcccgtgagcgtattccgtcgtcggcctaccacctcgaaggggtacaacgtggtacaactatttacgaaccctagtacagggtacgacgtacccgaaggacaaggaaacggaaccggtagggcctaaggaaccgtttagtttacctaggttaacctaaactttcctttaaccgaaggtaacctaatacgtaaggttacccggttaactttaagttcggttaccgttaacggggtaaaacgttccgggggaaaaccttacgggggtacctaaaccccgggttccttaacggggtacctaaccgccccggaaaaccggacccccaaaacccccttaacgtccggttaaacccaccttttaccgttaccccccgg

SEQ ID NO: 322895 - DNA, 582 bp, Homo sapiens
  misc_feature: GZ8MTXP02F3S9E.51.6.A06.1.454.CMB.2.raw
  modified_base (295)..(295): a, c, t, g, unknown or other
  misc_feature (295)..(295): n is a, c, g, or t
  modified_base (330)..(330): a, c, t, g, unknown or other
  misc_feature (330)..(330): n is a, c, g, or t
  modified_base (459)..(459): a, c, t, g, unknown or other
  misc_feature (459)..(459): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgaagcctctggattcagcttcagtacgtatggtttgcgcgtgggtccnccaggcctccgaggcaaggggactggcaggtgggngcatctatatcatatgaaaggagcaaataaaatactacgcaagacctaccgtagaaacggggcccgtaattccgaacctatacctaccaagaacgaaccaaactccccaaaagaaccaactaactttanctagacctaaatcgaaaccaccctaggaactacgttggaacggaaccgacggtcttacggtacttatttaacgtttggacgtacggaaggaaggggaacgtagttacgaactccaacgaacgg

SEQ ID NO: 322896 - DNA, 540 bp, Homo sapiens
  misc_feature: GZ8MTXP02HZP4K.51.6.A06.1.454.CMB.2.raw
  modified_base (198)..(198): a, c, t, g, unknown or other
  misc_feature (198)..(198): n is a, c, g, or t
  modified_base (302)..(302): a, c, t, g, unknown or other
  misc_feature (302)..(302): n is a, c, g, or t
  modified_base (366)..(366): a, c, t, g, unknown or other
  misc_feature (366)..(366): n is a, c, g, or t
  modified_base (413)..(413): a, c, t, g, unknown or other
  misc_feature (413)..(413): n is a, c, g, or t
  modified_base (436)..(436): a, c, t, g, unknown or other
  misc_feature (436)..(436): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtncagtcgtgggggagcgtggtccagcctggggaggtccctgagactctcctgtgaagcctctggattcagcttcagttacgtatggtttgcgtcgtggggtcccnccgaggcctccgaggccaaaggggctggcgaggtggggtgcagtctatatcatatagaaaggancaaataaatactacgacagactcgagaacggcgatcacatcacaganacacaccaagaacactactttanactagactaaatacgaacacccgtagaacgtacttaggaacgaccgacggtactagtactagttacgtcgtagacgaaggagggagtacgtacgatacgacacg

SEQ ID NO: 322897 - DNA, 509 bp, Homo sapiens
  misc_feature: GZ8MTXP02IPH96.51.6.A06.1.454.CMB.2.raw
  modified_base (415)..(415): a, c, t, g, unknown or other
  misc_feature (415)..(415): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccactattcttattggtaccagcagaagccaggccaggcccctgtgttgttgatatataaagacactgagaggccttcagggatccctgacgcgtattctctcggcctccacctcagggacaatggtcacattgaccatcagtgagtccaggcagaagacgaggctgactattctgtcaattcttnagacatcagtggtacttatgttctcggaactcgggaccaaggtcaaccgtctaggtcacgtcccaaggtcccaacccactgtaccactcttccg

SEQ ID NO: 322898 - DNA, 576 bp, Homo sapiens
  misc_feature: GZ8MTXP02HF8QN.51.6.A06.1.454.CMB.2.raw
  modified_base (296)..(296): a, c, t, g, unknown or other
  misc_feature (296)..(296): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggagtccctgagctctctgtgagcctctggattcagcttcagtacgtattggtttgcgcgtgggtccnccgaggctccgaggcaagggactggcgaggtgggtggctagtctagtatcatataggaaaggaagcaaaattaaactacgtacgactaagacctacccggtaggaacgggacctacgttacaccctatctacccaagaacgaaccaaacaacccgaaagaaacctaactacttttaacactagaactaaaatacgaaacctaaccgtacgagtacgtagacggacacggtctcgtactattcgtgtacgtagaaggaggacgatacggactcgaacgacg

SEQ ID NO: 322899 - DNA, 678 bp, Homo sapiens
  misc_feature: GZ8MTXP02H5PB6.51.6.A06.1.454.CMB.2.raw
  modified_base (257)..(257): a, c, t, g, unknown or other
  misc_feature (257)..(257): n is a, c, g, or t
  modified_base (300)..(300): a, c, t, g, unknown or other
  misc_feature (300)..(300): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttccgcgttagctctttaagaggtgtccagtgtcaggtgcagctggtgcagtcgtgggggagcgtggtccagcctgggaggtcctgagactctcctgtgaagcctcnggattcagcttcagtacgtatggtttgcgtcgtggggtccccncgagctacgaaggcgaagggctgacgtaggtgggcgactatactatatactagtagtaggaaaggaacactaaaattaaaactaccgtaacgacgtaacgtaccgttacggacggtaaacggccgtaacgttaccgaacctacgttaccgtaaccgaacgaacgaaacctaacctaaacccgaaacgtaaacctaaaccgttaacttttaacgaccgtaacgaaacgtaaaacgtaaaccgtaaaccgtaaccgtaacgtaacgtaacgtaacggtaacggtaacggtaaccggtacgttacgttacgttaacgttacgttacggtacggtacggtaaggtaacgggtaacggtacgtacgtacgtaacgaacgaacg

SEQ ID NO: 322900 - DNA, 572 bp, Homo sapiens
  misc_feature: GZ8MTXP02G5SAI.51.6.A06.1.454.CMB.2.raw
  modified_base (440)..(440): a, c, t, g, unknown or other
  misc_feature (440)..(440): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaaaccctatattcttattggtaccagcagacgccaggccacggccctgtgttgttgatataataaagacactgagagccttgaggactcctgagcgtattctctcgctccactcgagggacaagtggtacactattacgacctataccgaggtaggacgtaccgaggacaaggaagacggaggctagacttagttactagtactaaatcttanagtatatcgagttgttaacttagttgttacgttacggaacttacggggaacctaaggtcctaccgtaccgtacggtaccaacgtacccgaacggaccccaaacccgtactcggtaccaccgttcttaccccg

SEQ ID NO: 322901 - DNA, 495 bp, Homo sapiens
  misc_feature: GZ8MTXP02GQ052.51.6.A06.1.454.CMB.2.raw
  modified_base (259)..(259): a, c, t, g, unknown or other
  misc_feature (259)..(259): n is a, c, g, or t
  modified_base (297)..(297): a, c, t, g, unknown or other
  misc_feature (297)..(297): n is a, c, g, or t
  modified_base (343)..(343): a, c, t, g, unknown or other
  misc_feature (343)..(343): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
  modified_base (427)..(428): a, c, t, g, unknown or other
  misc_feature (427)..(428): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
  modified_base (472)..(472): a, c, t, g, unknown or other
  misc_feature (472)..(472): n is a, c, g, or t
  modified_base (486)..(486): a, c, t, g, unknown or other
  misc_feature (486)..(486): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggagcgtggtccaggcctggggacgtccctgagactctctgtgaacgctntggatcagcttcagtacgtatggttgcgtcgtgggccncgaggcctccgaggcaagggctggcaggtgggtgacattctatatnaatagtagaaaggaacacaaataaagtacagcagactcgagacggcatacanatcgcaganactaanaccaaaanacactatannananaananacacacganatagagacgacgactactatatatgngagaagagagacanacacacacg

SEQ ID NO: 322902 - DNA, 550 bp, Homo sapiens
  misc_feature: GZ8MTXP02GRZ42.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccatattcttattggtaccagcagagccaggccaggcccctgtgttgtgatatataaagacactgagaggccttcgagggactccctgagcgattctctcggcctccacctcgagggacaagtcggtacacattcgaccatcagtgagtccaggcaagaagacgaggctagactattctgtacaaattcttacagactatactagtaggttacttagttgtcgttacggaacgtcgggaacctaaaggtccaccgttaccgtacggtaccaacggacccaaacggacccaaaccccgtactacgtaccaccgttctacccg

SEQ ID NO: 322903 - DNA, 588 bp, Homo sapiens
  misc_feature: GZ8MTXP02HRLI9.51.6.A06.1.454.CMB.2.raw
  modified_base (467)..(467): a, c, t, g, unknown or other
  misc_feature (467)..(467): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgctattcgacccaaacccacttattcttattcggtaccagcagaagccaggccacggccctgtgttgtgatatataaagacactgagaggtccttacgagggactcccgtgagcgtattctcgtcggcctcccacctcgaggggaaccaagtcgggtacaactattcgaaccattcaaggtggacgtcccgaggcaaggaagaacgagggtctacggtaactttattaccgttgtactaaattctttanaagtacctatactaggtcgttaattgtgttacgttacggacgtacggaacgtaaaggtccgtacgttcgtacggtacacgacccgaacgcccaaaccctctcgtacaccgttcttaccccg

SEQ ID NO: 322904 - DNA, 496 bp, Homo sapiens
  misc_feature: GZ8MTXP02FKC0A.51.6.A06.1.454.CMB.2.raw
  modified_base (346)..(346): a, c, t, g, unknown or other
  misc_feature (346)..(346): n is a, c, g, or t
  modified_base (432)..(432): a, c, t, g, unknown or other
  misc_feature (432)..(432): n is a, c, g, or t
  modified_base (445)..(445): a, c, t, g, unknown or other
  misc_feature (445)..(445): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagcaggccaggcccctgtgtgttgatatataaagacactgagaggcttcagggntccctgagcgattctctgctccacctcagggacaatgcacattgaccatcagtgagtccaggcagaagacgaggctgactatttcngtacaatcttcanacactacagtaggtaattatagtcttacggtaacgtacggtacgaaaccgg

SEQ ID NO: 322905 - DNA, 595 bp, Homo sapiens
  misc_feature: GZ8MTXP02GF0LV.51.6.A06.1.454.CMB.2.raw
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
  modified_base (330)..(330): a, c, t, g, unknown or other
  misc_feature (330)..(330): n is a, c, g, or t
  modified_base (361)..(361): a, c, t, g, unknown or other
  misc_feature (361)..(361): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggagcgtggtccagccgtggggacgtccctgacgctctctgtgacgcctntggattcagcttcagttacgtatggtttgcgtcgtgggtcccnccgaggcctccgaggcaaggggctgcgnggtgggtgcatctatatcatagtagaaggancaaataaactactacgacagacctccgtagaacgggccattccactatcctaccgaagtacgaaccaactacccaaaagaactaaccttacctttatccgtagaaccaaacgttcgaaacctacccgagaacgtacgtacggacgaaccgacggtcttacggttacttaacgtttagttacggtggaacggtaaggggaacgggtaagtacgtacggaactaccaacggtaccg

SEQ ID NO: 322906 - DNA, 600 bp, Homo sapiens
  misc_feature: GZ8MTXP02HFNI2.51.6.A06.1.454.CMB.2.raw
  modified_base (256)..(256): a, c, t, g, unknown or other
  misc_feature (256)..(256): n is a, c, g, or t
  modified_base (340)..(340): a, c, t, g, unknown or other
  misc_feature (340)..(340): n is a, c, g, or t
  modified_base (493)..(493): a, c, t, g, unknown or other
  misc_feature (493)..(493): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggagtccctgagactctcctgtgaagcctntggattcagcttcagtacgtatggttgcgcgtgggtcccgccgaggcctccgaggcaaggggcttcgaggtgggtggcatctanactcagtataggaaaggagacaagtaaaatactaacgacaagtacctccggtaggaaacggggcctaagttccaacctatccgtacccgaagaacgaactaaactaccccgaaagaaaccactaactttagtacctagacaaaatcgaaaccncccgtagaacgtacgttagaacggtaccacgggcttggtacttaagttagtttcggacgtacggaaggaaggggaagtacgttacggaaattccgaacgaacggccg

SEQ ID NO: 322907 - DNA, 494 bp, Homo sapiens
  misc_feature: GZ8MTXP02JWCZT.51.6.A06.1.454.CMB.2.raw
  modified_base (239)..(239): a, c, t, g, unknown or other
  misc_feature (239)..(239): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (341)..(341): a, c, t, g, unknown or other
  misc_feature (341)..(341): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (448)..(448): a, c, t, g, unknown or other
  misc_feature (448)..(448): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagttttgggctgagctgggttttcctcgttgctcttttaaagaggtgtccagtgtcaggtgcagctggtgcagtctgggggaggcgtggtccagcctgggagtccctgngactctcctgtgaagcctctggattcagcttcagtacgtatggtttgcgntggggtcccnccaggctccaggcaaagggctgcaggtgggtgcatcatatcntatgaagagcaaataaancctagcngactcgtgaaggccgattcaccatctccagagcaaatcccaaagaacacactttatctagcaaatgaacaccctgagacttnaggacacggctgtctattatgtgcgaagagggagatcgatcacacg

SEQ ID NO: 322908 - DNA, 577 bp, Homo sapiens
  misc_feature: GZ8MTXP02HARQ7.51.6.A06.1.454.CMB.2.raw
  modified_base (300)..(300): a, c, t, g, unknown or other
  misc_feature (300)..(300): n is a, c, g, or t
  modified_base (332)..(332): a, c, t, g, unknown or other
  misc_feature (332)..(332): n is a, c, g, or t
  modified_base (462)..(462): a, c, t, g, unknown or other
  misc_feature (462)..(462): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccaggcctggggacggtccctgagactctcctgtgaagcctctggattcagcttcagtacgtatggttgcgctgggtcccncgaggctccgaggcaagggctggcaggtgggngcagtctatatcatataggaaaggaagcaaaataaactacgtacgcagacctcccgtaggaacgggccgtattaccaaccatacctaccaagaacgaacaaactacccaaagaaccaactaacctttaanactacgaactaaactacgaaaccaccgtagaacgtacgtaggacgacgacggtcttacgtacttattacgtacggtaggacggaaggagggaacgtacgtacgactacgacgacg

SEQ ID NO: 322909 - DNA, 526 bp, Homo sapiens
  misc_feature: GZ8MTXP02FV8BU.51.6.A06.1.454.CMB.2.raw
  modified_base (300)..(300): a, c, t, g, unknown or other
  misc_feature (300)..(300): n is a, c, g, or t
  modified_base (335)..(335): a, c, t, g, unknown or other
  misc_feature (335)..(335): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (434)..(434): a, c, t, g, unknown or other
  misc_feature (434)..(434): n is a, c, g, or t
  modified_base (475)..(475): a, c, t, g, unknown or other
  misc_feature (475)..(475): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggaggtccctgagactctcctgtgaagcctctggattcagcttcagtacgtatggtttgcgtcgtggggtcccnccgaggcctccgaggcaaggggctggcaggtgggngcatctatatcatatgaaagagcaaataaactacgtacgcaagactcgtagaacgggccatcactatcnccaganacaatcccaaagacactactttanctagacaaatgaacacctgactactgaacggacacggtctntactaattacgttcgagtacggaaggaggggatactcgtaacacgacgacg

SEQ ID NO: 322910 - DNA, 539 bp, Homo sapiens
  misc_feature: GZ8MTXP02HRLQH.51.6.A06.1.454.CMB.2.raw
  modified_base (409)..(409): a, c, t, g, unknown or other
  misc_feature (409)..(409): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggatcacctgctctggagatgcattgccaaacccactattcttattggtaccagcagaagccaggccaggcccctgtgttgttgatatataaagacactgagaggccttcgagggatccctgagcgtattctctcggcctccacctcgagggacaagtggtcacattcgaccatcagtgagtccaggcagaagacgagctagactatttcngtactaaattctttacagtacattacgagttcggtacttattgttcttacgggaactcgggaacctaggtcctaccgtctacggcaacgcccaaaggcccaaacccgtactcgtaccaccgttcttcccg

SEQ ID NO: 322911 - DNA, 503 bp, Homo sapiens
  misc_feature: GZ8MTXP02HC7L4.51.6.A06.1.454.CMB.2.raw
  modified_base (440)..(440): a, c, t, g, unknown or other
  misc_feature (440)..(440): n is a, c, g, or t
  modified_base (489)..(489): a, c, t, g, unknown or other
  misc_feature (489)..(489): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgtgatatataaagacactgagaggccttacgagggatccctgagcgattctctcggctccgacctcgagggacaagtggtcacattgacctatcagtgagtccaggcagaagacgaggctagactagtttctagtctaatcttacagacatcagtgtacttatntctgaactggacaggtcacgtctacggtcacgacccaaggcccaacccnctcgtcactctccg

SEQ ID NO: 322912 - DNA, 498 bp, Homo sapiens
  misc_feature: GZ8MTXP02I7VHZ.51.6.A06.1.454.CMB.2.raw
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
tcagcgatcgtatacacgaccggtgctcgatttagatctactgacaggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattctattggtaccagcagaagccaggccaggcccctgtgtgttgatatataaagacactgagaggccttcagggatccctgagcgattctctcggctccacctcaggacaatggtcacattgaccatcagtgatccagcagaagacgagctgactattcngtcaatcttnagacatcagtgtactatgtcttcgaaactgggacaaggtcaaccgtctacggtcagacccgaaggcccaaacccactcgtactacctcttacccg

SEQ ID NO: 322913 - DNA, 584 bp, Homo sapiens
  misc_feature: GZ8MTXP02IOYSR.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaaccacttatttcttaattggtaccagcagaagccaggccaggcccctgtgttgttgatatataaagacactgagaggccttcgagggtactccctgagcgtattctctcgcctccacctcgagggacaatggtacactattcgacctatcaggtggagtcccgaggacaggaaagacggaggactgaacttattctagtactaattcttacagtactatcgtagtcggttactttatgtttacgttacggaacgttcgggaacctaaaggtccgtaaaccgttccgtacggtaccgaacgtaccccgaaaacggcccctaaacccccgtactaccgtacctacctcgtttaccccg

SEQ ID NO: 322914 - DNA, 619 bp, Homo sapiens
  misc_feature: GZ8MTXP02GKSKB.51.6.A06.1.454.CMB.2.raw
  modified_base (295)..(295): a, c, t, g, unknown or other
  misc_feature (295)..(295): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctctgtgaagcctctggattcagcttcagtacgtatggttgcgtcgtgggtcccncaggctccgaggcaaggggctgcaggtgggtgctagtctatacgtcatataggaaaggaagcaaaataaaactactaccgacaaggacctccggtagaaacgggacccgtaattaccacctaagttaccaccgaaagaacgaaccaaaactccccgaaaagaaacctaactaaccttttatacctagaacaaaacttcgaaacctacccgtagaacgaaccttaggaaacggtacaccgggtacttacggtacttaacgttacgtttacgggacggaacggaagggtacgggaacgtaacgtaccgtaacgtaccgaacgaacg

SEQ ID NO: 322915 - DNA, 624 bp, Homo sapiens
  misc_feature: GZ8MTXP02H1BMH.51.6.A06.1.454.CMB.2.raw
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
  modified_base (366)..(366): a, c, t, g, unknown or other
  misc_feature (366)..(366): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccaggcctgggaggtccctgagactctcctgtgacgcctntggattcagtcttcagtacgtatggtttgcgtcgtgggtcccnccgaggcctccgaggcaaggggctggcgaggtgggcgctatctatatacatagtagaaaggaancaaaattaaactactacgacaacgactacccggtagaaacggggccctaattaccaaccgtacttaccgtacccaaggaacgaaaccaaacctacccaaaagaaacctactaaaccttttatacccgtagaaaccaaaattaccgaaaacctacccgtagaaacgtacgtaggaacggtaccaacggtcctagttactaagtttactggtacggacggtaaagggacgggtaagacgttaccggaactacaacgacgg

SEQ ID NO: 322916 - DNA, 568 bp, Homo sapiens
  misc_feature: GZ8MTXP02INHCH.51.6.A06.1.454.CMB.2.raw
  modified_base (340)..(340): a, c, t, g, unknown or other
  misc_feature (340)..(340): n is a, c, g, or t
  modified_base (492)..(492): a, c, t, g, unknown or other
  misc_feature (492)..(492): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgcccaacccacttattcttattggtaccagcaagagccaggccacggcccctgtgttgtgatataataaagccactgaagnggtccttcgagggctccctggacgcgtattctcgtggccctccacccttcgaacgggtaaccaaagttcggaccaactagttacgaacctataccgaggttaggaacgtcccgaggacaaggaaagacgaggtctagtaccttatttacgtnttaactactactacaagactacgtactagttacgttaattacgtacgttacgtacggtacgtacggaacgtaacgg

SEQ ID NO: 322917 - DNA, 559 bp, Homo sapiens
  misc_feature: GZ8MTXP02FN17U.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaacccactattcttattggtaccagcagagccaggccacggcccctgtgttgttgatataataaagaccacgtgagacggtccttacgagggtctccctgacgcgtattctctggcctccacctcgagggacaagtcgtcactattcgaccatacagtggacgtccgaggcaagaacgacgaggctagacttatttctagtactaaacttcttacaacgtacacttacgaaggttacggttaactttagtacggtttaccttacgggtaaacgttcggggaaccttaaaccggg

SEQ ID NO: 322918 - DNA, 487 bp, Homo sapiens
  misc_feature: GZ8MTXP02IU6F9.51.6.A06.1.454.CMB.2.raw
  modified_base (408)..(408): a, c, t, g, unknown or other
  misc_feature (408)..(408): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcagggatccctgagcgattctctggctccacctcagggacaatggtcacattgaccatcagtgagtccaggcagaagacgagctgactattctagtcaatcttnagacatcagtgtacttatgtctgactggacaggtcacgtctaggtcacgccaagcccaacccgactcgtcactctaccg

SEQ ID NO: 322919 - DNA, 547 bp, Homo sapiens
  misc_feature: GZ8MTXP02G23NL.51.6.A06.1.454.CMB.2.raw
  modified_base (258)..(258): a, c, t, g, unknown or other
  misc_feature (258)..(258): n is a, c, g, or t
  modified_base (300)..(300): a, c, t, g, unknown or other
  misc_feature (300)..(300): n is a, c, g, or t
  modified_base (358)..(358): a, c, t, g, unknown or other
  misc_feature (358)..(358): n is a, c, g, or t
  modified_base (440)..(440): a, c, t, g, unknown or other
  misc_feature (440)..(440): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtgggagtccctgagactctcctgtgagcctntggattcagcttcagttacgtatggtttgcgcgtgggtcccncgaggctccgaggcaaggggctggcgaggtgggtgcatctatatcatatggaaaggancaaataaactactacgacagacctcggtagacggaccatacaccatcaccagacgaacaactcccaaagaccactactttanctagaacaaagtacgaaccaccgtagacgtacgttagaacggtacacggcttagtactagttagttacggagacgaaggtacgggaatagtacggactacaacgacg

SEQ ID NO: 322920 - DNA, 541 bp, Homo sapiens
  misc_feature: GZ8MTXP02JKBGD.51.6.A06.1.454.CMB.2.raw
  modified_base (297)..(297): a, c, t, g, unknown or other
  misc_feature (297)..(297): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (426)..(426): a, c, t, g, unknown or other
  misc_feature (426)..(426): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctggggaggtccctgagactctcctgtgaagcctctggattcagcttcagtacgtatggtttgcgctgggtccncaggctccaggcaaggggctgcaggtgggtgcatctatatcatatgaaggaancaaataaactacacgnagactcgtagaacggccatcactatcaccagacgaacactaccaaagaccaactacttancgtagacaaatacgaacctacctagaacgtacgtagaacggacacggtctagtacttaagtttacgtcggtacgacggaaggaacgggtaagtacgtacgaactaccgaacgacg

SEQ ID NO: 322921 - DNA, 555 bp, Homo sapiens
  misc_feature: GZ8MTXP02JTB3D.51.6.A06.1.454.CMB.2.raw
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (399)..(399): a, c, t, g, unknown or other
  misc_feature (399)..(399): n is a, c, g, or t
  modified_base (431)..(431): a, c, t, g, unknown or other
  misc_feature (431)..(431): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctggtgaacgcctctggattcagtcttcagtacgtatggtttgcgtcgtgggtcccncgaggcctccgaggcaaggggctgcaggtgggngcatcatatcatangaaggancaaataaatactacgcagactcgtagaacgggccatcactatcncagacgacactacccaaagaccactactttanctagaactaaatacgaacctaccgtagacgtacgtaggaacggtacgtacggtctacgtacttaacgttacgttcggtacggacggtaagggtagggtacgtacgtacgacgtaccgaacgacg

SEQ ID NO: 322922 - DNA, 559 bp, Homo sapiens
  misc_feature: GZ8MTXP02JBMBU.51.6.A06.1.454.CMB.2.raw
  modified_base (429)..(429): a, c, t, g, unknown or other
  misc_feature (429)..(429): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaacccacttattcttattggtaccagcagaagccaggccaggcccctgtgttgttgatatataaagacactgagaggcctttcaggggatcccgtgagcgattctctcggcctccacctcaggggacaagtggtcacattgaccatcagtggagtccaggcaagaagacgagggctgacttatttctagtctaaatcctttanagacatcgagttggtaacttagtgttcgttacggaacgttcgggaacctaaagggtccaaaccggtccgttaacggtccacgaccccgaaaggccccaaaacccgctacgtccaaactccgtttaacccg

SEQ ID NO: 322923 - DNA, 502 bp, Homo sapiens
  misc_feature: GZ8MTXP02G3S81.51.6.A06.1.454.CMB.2.raw
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (257)..(259): a, c, t, g, unknown or other
  misc_feature (257)..(259): n is a, c, g, or t
  modified_base (261)..(262): a, c, t, g, unknown or other
  misc_feature (261)..(262): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
  modified_base (306)..(307): a, c, t, g, unknown or other
  misc_feature (306)..(307): n is a, c, g, or t
  modified_base (309)..(309): a, c, t, g, unknown or other
  misc_feature (309)..(309): n is a, c, g, or t
  modified_base (313)..(314): a, c, t, g, unknown or other
  misc_feature (313)..(314): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (361)..(362): a, c, t, g, unknown or other
  misc_feature (361)..(362): n is a, c, g, or t
  modified_base (367)..(367): a, c, t, g, unknown or other
  misc_feature (367)..(367): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggtttcgcgtaggcgtctttaagaggtgtccagtgtcaggtgcagctggtgcagtctgggggagcgtggtccagcctgggagtccctganctctctgtgagcctntggatnnntnntagtgtgtgngngtgcgcngcncgngngagngngngngtggngnntntatnnatanagagaganaataatacananagacgtcgagagacgactacacnncacanacacacacaacaactactacttatactacacaacacgaacctaccgtacgtacgtacgtacgacgtacgtacgtacgtacgtacttacgttacgttacgtagaggaaggaggacgtacgtacgacgacgacgacg

SEQ ID NO: 322924 - DNA, 590 bp, Homo sapiens
  misc_feature: GZ8MTXP02JC19B.51.6.A06.1.454.CMB.2.raw
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
  modified_base (484)..(484): a, c, t, g, unknown or other
  misc_feature (484)..(484): n is a, c, g, or t
  modified_base (535)..(535): a, c, t, g, unknown or other
  misc_feature (535)..(535): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggagtccctgagctctctgtgagcctntggattcagcttcagtacgtatggttgcgtcgtgggtcccncgacggcctaccgaggcaaggggactggcgaggttgggcgctagtctaatatcaatagtaggaaaggtaagacctaaaataaataccgtaacgactaaggtacctaccgggtagaacggggcctattaccaaccctatacctaccgaaaggacaaccaaactacccaaagaaacctactaactttanacctagaaccaaagtacgaacctaccgtgaacgtactaggacgtacgacgntacgtacttagttactaggtcgaggaaggacggtagactacgagtaccacgtacg

SEQ ID NO: 322925 - DNA, 514 bp, Homo sapiens
  misc_feature: GZ8MTXP02JM6G3.51.6.A06.1.454.CMB.2.raw
  modified_base (295)..(295): a, c, t, g, unknown or other
  misc_feature (295)..(295): n is a, c, g, or t
  modified_base (350)..(350): a, c, t, g, unknown or other
  misc_feature (350)..(350): n is a, c, g, or t
  modified_base (428)..(428): a, c, t, g, unknown or other
  misc_feature (428)..(428): n is a, c, g, or t
  modified_base (483)..(483): a, c, t, g, unknown or other
  misc_feature (483)..(483): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgaagcctctggattcagcttcagtacgtatggtttgcgctgggtcccncaggctccgaggcaaggggctgcaggtgggtgcatctatatcatatgaaaggaancaaataaatactacgcagactccgtagaacggccgattcaccatctccagagacaactacccaaagacactactttanctagacaaatacgaaccaccctagacgtactgaacggtacacggctgtactattntgtgacgaagagggagacgtcgatacacacg

SEQ ID NO: 322926 - DNA, 536 bp, Homo sapiens
  misc_feature: GZ8MTXP02G6ZLC.51.6.A06.1.454.CMB.2.raw
  modified_base (301)..(301): a, c, t, g, unknown or other
  misc_feature (301)..(301): n is a, c, g, or t
  modified_base (357)..(357): a, c, t, g, unknown or other
  misc_feature (357)..(357): n is a, c, g, or t
  modified_base (440)..(440): a, c, t, g, unknown or other
  misc_feature (440)..(440): n is a, c, g, or t
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtgcagtcgtgggggaggcgtggtccagcctgggagtccctgagactctcctgtgaagcctctggattcagcttcagttacgtatggtttgcgcgtggggtcccncgaggctccgaggcaaggggctgcaggtgggtgcatctatatcatatgaaaggaancaaataaatactacgcaagacctccggtagaagggccattcacatctccaagacacaactacccaaagaaccactactttaanctagaccaaatacgaaccaccctagaacgtacttagaacggacacgggcttagtcttaattagtcgtagnggaagagggganagtcgatcaacacg

SEQ ID NO: 322927 - DNA, 499 bp, Homo sapiens
  misc_feature: GZ8MTXP02H475A.51.6.A06.1.454.CMB.2.raw
  modified_base (419)..(419): a, c, t, g, unknown or other
  misc_feature (419)..(419): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgtgatatataaagacactgagaggccttcgagggatccctgagcgattctctcggctcccacctcgagggacaagtggtcaacattcgaccatcagtggatccaggcagaagacgaggctgacttattctagtcaaatcttanagacatcagtgtacttatgtctgaactgggacaaggtcaccgtctacgcagcccaaggcccaacccactcgcactctccg

SEQ ID NO: 322928 - DNA, 586 bp, Homo sapiens
  misc_feature: GZ8MTXP02GXLJJ.51.6.A06.1.454.CMB.2.raw
  modified_base (447)..(447): a, c, t, g, unknown or other
  misc_feature (447)..(447): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgctattcgacccaaacccacttatttcttattcggtaccagcagaagccaggccaggcccctgtgttgttgatataataaagacactggagacggtccttgaggactcccgtggagcgtattctcgtcggtcctccacctcgagggacctaagtcggtacaactagttacgacctatacgaggtggacgtacccgaggacaaggaacgacgaggctagacttattcgtntacaattcttacagtacatctaggttacgtacttagtcgttacgttacggaacgtcggaaccgtaaggtcccaaccggttcgtacggccacgacccgaacggccccaaacccgtactcgtacctacctcgtttaccccg

SEQ ID NO: 322929 - DNA, 695 bp, Homo sapiens
  misc_feature: GZ8MTXP02JTW6G.51.6.A06.1.454.CMB.2.raw
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
  modified_base (301)..(301): a, c, t, g, unknown or other
  misc_feature (301)..(301): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgctctttaagaggtgtccagtgtcaggtgcagctggtgcaggtcgtgggggagcgtggtccagccgtggggagtccctgacgctctcctgtgacgctntggattcagtcttnagtacgtntggttgcgtcgtggggtcccncaggcctaccgaggacgaagggactgggcgtagggtggggtgctagtctatatctaattagaggaaaagggaatacctaaaagttaaaactaccgtaacggactaacggtacctacccggggtaaggaaaccgggggtccctaacttacccgaaccctaacgttccgtaacccgaaggtaaaccgaaacctaaaccgtaacccccaaaacgtaaaccctaaaccttaactttaactccgttaacgaaacctaaaactaccgaaaccctaacccgtagaacgtacgttacgggaacgtaaccgtacggggtaccttacggttacttaagtttcggttaggtaacggacggtaaggggtagggtaacgacgtaccggacttaaccggaacaaccgg

SEQ ID NO: 322930 - DNA, 502 bp, Homo sapiens
  misc_feature: GZ8MTXP02GZWXP.51.6.A06.1.454.CMB.2.raw
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
  modified_base (418)..(418): a, c, t, g, unknown or other
  misc_feature (418)..(418): n is a, c, g, or t
  modified_base (486)..(486): a, c, t, g, unknown or other
  misc_feature (486)..(486): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttaattggtaccagcagaagccaggccaggcccctgtgtgttgatataataaagacactgagaggccttcgagggactccctgacgcgattctctggcctccacctcgaggacaatggtcanattgaccatcagtganccgagcagaagacgaggctagacttattctgtacaaattcttanatacatcagtcgtatatgtctacgaactcggacaaggtccacgtctagcacgccgaagccctaacccnctcgtcactcgtcccg

SEQ ID NO: 322931 - DNA, 520 bp, Homo sapiens
  misc_feature: GZ8MTXP02JDRJJ.51.6.A06.1.454.CMB.2.raw
  modified_base (306)..(306): a, c, t, g, unknown or other
  misc_feature (306)..(306): n is a, c, g, or t
  modified_base (416)..(416): a, c, t, g, unknown or other
  misc_feature (416)..(416): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttnagggatcccgtgagcgattctctcggcctccacctcgagggacaatggtcacattgaccatcagtgagtccaggcagaagacgaggctagactattctgtactaatcttnagacatcgagtgtacttatgttcttacggaacttcgggacctaggtccaaccgtcctacggtccacgacccaaggcccaaaccctactcgtacactcttacccg

SEQ ID NO: 322932 - DNA, 556 bp, Homo sapiens
  misc_feature: GZ8MTXP02JAOXZ.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgagtcctcctatgtgctgacacagccaccctcggtgtccgtgtccccaggacagacggccaggatcacctgctctggagatgcattcgacccaaacccattattcttattggtaccagcagagccaggccacggccctgtgttgttgatatataaagacactgagaggccttgagggactccctgagcgattctctcggctccacctacgacgggacaagtggtacactattcgaccatcgagtggacgtccgaggcaagaagacgaggactgtaactattctagtacaattcttacagacatcgagtggtacttatgttacgttacggaacgttcgggaccaaggtaccgtaaccgtccgtaggtaccgacgacccgaacggaccccaaaccccgactcggtacctacctcgttacccg

SEQ ID NO: 322933 - DNA, 661 bp, Homo sapiens
  misc_feature: GZ8MTXP02HGKHC.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaaccctactatttcttatggtaccagcagaagccaggccacggcccctgtgttgtgataataataaagacactgaagaggccttgaggactccctgacgcgtattctctcggcctccaccctcgagggacaagtcggtacaacattacgaaccctatacgaaggtaggtaacgtacccgaagggaccgaaggaaaacgaacggaacggacttacggtaactttagtttcgtacgtactaaattccctttagaacgtaacctaatcgtaaggtaggttaaccttaagttcgttaccgtttacggggaaacttcggggaaaccgtaaacgggtccaacccggttaccgttaacggtacccgaaccggaaccccgaaaccgggtaccccaaaacccccgtacgtaccgtacccgtaacctttcccgttcccccgg

SEQ ID NO: 322934 - DNA, 630 bp, Homo sapiens
  misc_feature: GZ8MTXP02HWH1R.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccatattcttatggtaccagcagaagcaggccaggccctgtgttgtgatatataaagacactgagaggcctttacgagggtactcccgtgagcgtattctctcggctacccacctacgtagggaccaagtgggtacactagttcgaacctatcaaaggtgtacgtccgaaggccaaggaaacgacggacgggctaggacttattacgtagttacctaaattctttacagtactaaccgttacgaggttaggttaactttagtagttaccgtttacggaaacgtttcgggaaacccgtaaaggtacccgtaaacccggttaccgtacggttacccgaacgaccccgaaacgggtaccccaaaccccgtactacggttaaccctaacctttaccgtttcccccgg

SEQ ID NO: 322935 - DNA, 669 bp, Homo sapiens
  misc_feature: GZ8MTXP02G7MFU.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaaccacttattcttattggtaccagcagaagccaggccaggcccctgtgttgttgatataataaagacactgagaggccttcgagggactccctgagcgtattctcgtcggcctccacctcgaaggggaccaaagtcgggtacactattcgaacctataccgaggtgacgtcccgaagggcaaaggaaagacggaacggctaggtaccttagtttcgtagttactaaattctttacaacgtacctagttaccgtaaggttcggttaactttagttcggttaccgtttaacgggaaaacgtttcggggaaaaccgtaacgggttaccctaaacccgggttacccgttaacgggttacccgtaaccggaacccccggaaaacgggtacccccaaaacccccgtacgtaccggtaaccctaacccgtttcctttacccccggg

SEQ ID NO: 322936 - DNA, 586 bp, Homo sapiens
  misc_feature: GZ8MTXP02JMW9R.51.6.A06.1.454.CMB.2.raw
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctctgtgagcctntggattcagtcttcagtacgtatggttgcgcgtgggtccncaggctcgaggcaagggctgcaggtgggtgcatctatatcatangaaggaancaaataaatcctacgcaaggtacctccggtagaacgggccgtattccacctatcctaccgaagaacgaaccaaactaccccgaaaagaacctaactaactttaactacgtacgaaactaaacgtacgaaaacctacccgtaggaacgtaacgttaggaacggtaaccgtacgggtcttaggtacttaattacgttcggtagacggtaaggaacgggagacgtaccgaatacgaacgaacg

SEQ ID NO: 322937 - DNA, 532 bp, Homo sapiens
  misc_feature: GZ8MTXP02GI6XA.51.6.A06.1.454.CMB.2.raw
  modified_base (295)..(295): a, c, t, g, unknown or other
  misc_feature (295)..(295): n is a, c, g, or t
  modified_base (387)..(387): a, c, t, g, unknown or other
  misc_feature (387)..(387): n is a, c, g, or t
  modified_base (422)..(422): a, c, t, g, unknown or other
  misc_feature (422)..(422): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgaagcctctggattcagcttcagtacgtatggttgcgtctgggtccnccaggctccaggcaagggctgcagtgggtgcatctatatcatatgaaaggagcaaataaatctacgcagactcgtagaaggccatcacatcnccagacgacaactcccaaagacaactactttaacncgtacgacaaatacgaacctaccgtagacgtacgtacggaacgacgacggtactacgtactaattacgtcggagacggaaggacggacgtacgtacgaactcgaacgacg

SEQ ID NO: 322938 - DNA, 526 bp, Homo sapiens
  misc_feature: GZ8MTXP02ICT16.51.6.A06.1.454.CMB.2.raw
  modified_base (283)..(283): a, c, t, g, unknown or other
  misc_feature (283)..(283): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagagcaggccaggcccctgtgttgtgatatanaaagacactgagaggcttcgagggactccctgagcgattctctcggcctccacctcagggacaatggtcacacttgaccatcagtcggagtccaggcaagaagacgagctgactattctgtcaatcttcagacatcagtgtacttagttgtcgttacgaactacgggacctaagggtccaaccggtccgtacgtaccgacgacccaaacggccccaaaccccgactacgcctaactcttcccg

SEQ ID NO: 322939 - DNA, 582 bp, Homo sapiens
  misc_feature: GZ8MTXP02F78F3.51.6.A06.1.454.CMB.2.raw
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
  modified_base (378)..(378): a, c, t, g, unknown or other
  misc_feature (378)..(378): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggatcacctgctctggagatgcattgccaacccatattcttatggtaccagcagaagccaggccaggcccctgtnttgttgatataataaagaccactgagaggccttcgagggtntccctgaagcgtattctcgtcgtccnccctaccgtacgaagggactaaagttcggaccaactagttacgaacctattacgaggtaggtacgtacgacgacgaagaaacgacggaggtctaggtacttacgtttcgacgtactaaacttcttacgaacgtaacctatacgtaggttacggtaactttaagtcgttaccgttacggtaacgtacgggaacgttaaacccggg

SEQ ID NO: 322940 - DNA, 490 bp, Homo sapiens
  misc_feature: GZ8MTXP02HAIA1.51.6.A06.1.454.CMB.2.raw
  modified_base (478)..(478): a, c, t, g, unknown or other
  misc_feature (478)..(478): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaacccactattcttaattggtaccagcagaagccaggccaggcccctgtgtgttgatatataaagacactgagaggccttcgaggatccctgagcgattctctggctccactcgaggacaatggtcacattgaccatcagtgagtccaggcaagaagagaggctgactattctgtacaatcttcagacatcagtgtacttatgtctgaactggaccaaggtcacgctagtcacgacccaaggcccaacccancgtcactctccg

SEQ ID NO: 322941 - DNA, 522 bp, Homo sapiens
  misc_feature: GZ8MTXP02FVI18.51.6.A06.1.454.CMB.2.raw
  modified_base (346)..(346): a, c, t, g, unknown or other
  misc_feature (346)..(346): n is a, c, g, or t
  modified_base (397)..(397): a, c, t, g, unknown or other
  misc_feature (397)..(397): n is a, c, g, or t
  modified_base (432)..(432): a, c, t, g, unknown or other
  misc_feature (432)..(432): n is a, c, g, or t
  modified_base (489)..(489): a, c, t, g, unknown or other
  misc_feature (489)..(489): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggaggtccctgagctctcctgtgagcctctggattcagcttcagtacgtatggtttgcgcgtgggtcccgccgaggcctccgaggcaagggactgcaggtgggtgcagtcatatcatangaaaggagcaaataaatacacgcaagactcgtagaacggccatcaccatcnccaagacacaaactcccaaagaaccactactttanctagaacaaatcgaaccaccgtagagacttggacgacacgctgtcttagttactcgngtacgaaggtaggtagactgaactcgaacgacg

SEQ ID NO: 322942 - DNA, 544 bp, Homo sapiens
  misc_feature: GZ8MTXP02HK954.51.6.A06.1.454.CMB.2.raw
  modified_base (296)..(296): a, c, t, g, unknown or other
  misc_feature (296)..(296): n is a, c, g, or t
  modified_base (349)..(349): a, c, t, g, unknown or other
  misc_feature (349)..(349): n is a, c, g, or t
  modified_base (420)..(420): a, c, t, g, unknown or other
  misc_feature (420)..(420): n is a, c, g, or t
  modified_base (435)..(435): a, c, t, g, unknown or other
  misc_feature (435)..(435): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgaagcctctggattcagcttcagtacgtatggtttgcgcgtgggtccncaggctccgaggcaagggctgcaggtgggtgcatcatatcatatgaaaggaanactaaataaactacgacgacagacctacggagacggacctatacactatccacagacaacaactaccaaanaacctactactttanactacaacaaagtacgaacctaccgtagaacgtacgtaggaacgacgacgtactacgtacttagttacgtcggtagacggaaggaggacgtactacgactacgacgacg

SEQ ID NO: 322943 - DNA, 595 bp, Homo sapiens
  misc_feature: GZ8MTXP02GKZB0.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccatattcttattggtaccagcagaagccaggccaggcccctgtgttgttgatatataaagacactgagaggccttcgagggactccctgagcgattctctggctccactcagggacaagtggtcactattcgaccatcagtgagtccgagcaaggaagacgagctagaacttattctagtactaaattcttcaagtactatacgtaggttaggttaactttagtgttaccgtttacgggaaacgttacgggtaaacccgtaaagggtccctaacccggttaccgttacgggaaccaccggtacccccgaaacgggaccccctaaaaccccgacgttacggtaccctaaccttcccgtttccccgg

SEQ ID NO: 322944 - DNA, 678 bp, Homo sapiens
  misc_feature: GZ8MTXP02JMJDW.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggagtccctgagactctcctgtgaagcctctggattcagtcttcgagttacgtagttggttgcgtcgtcgggtcccgccgaggcctccgaggcgaaggggactggcgtaggtggggtcgctatctaatactcaatagtaggaaaaggaatactaaaattaaaataaccgtaacgactaaacggaaccttcccgggtaaaggaaaccggggtaccctaacttacccgaaccctaacgtaccctacccgaaaggaacctaaaccaaaacctaaccccgaaaagtaaacctaaaccttaaactttaactacgtacgaaacctaaaattaccgaaaaccctacccgtaggaacgtaacgttagaaacggtacctacgggtacttacggtacttaagtttagtacggtagacggtaagggaagggtacgaagtacggtactaccgaacgaaccgg

SEQ ID NO: 322945 - DNA, 557 bp, Homo sapiens
  misc_feature: GZ8MTXP02IK0LZ.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagagccaggccaggcccctgtgttgtgatatataaagacactgagaggccttcgagggactccctgagcgattctctcggctccacctcagggacaatgggtcactattcgaccatcgaagtggagtccgagcaaggaagacgaggctgacttattctgtactaaatcttacgagacatcgagtacggttacttatcgttacgttacgggaacgttacggggaacctaaggtccgtaccggtaccgttacggtaccacgaccccgaaacggacccaaacccgtctacgtcctacctcgtttaccccg

SEQ ID NO: 322946 - DNA, 569 bp, Homo sapiens
  misc_feature: GZ8MTXP02JM3GK.51.6.A06.1.454.CMB.2.raw
  modified_base (155)..(155): a, c, t, g, unknown or other
  misc_feature (155)..(155): n is a, c, g, or t
  modified_base (256)..(256): a, c, t, g, unknown or other
  misc_feature (256)..(256): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggtttccncgttagctcttttaagaggtgtccagtgtcaggtgcagctggtgcagtcgtgggggaggcgtggtccagcctgggagtccctgagctctctgtgaagcctntggattcagtcttcagtacgtatggttgcgcgtgggtccacaggctcgaggcaagggctgcagtgggncatntatatcatatagaagaagacaaataaataacgtacgacgacgacgtacgtacgaacggacgtactacactactactaccacgacgaacaactaaccaaacgaaactaactaacttactactacgtaacaactaacgaacaaccgtacgacgtacgtacgacggtaacgacggtacgtacgtacgttacgttacgttacgtagacggtaaggaggaacggtacgtacgtacgtacgacgacg

SEQ ID NO: 322947 - DNA, 515 bp, Homo sapiens
  misc_feature: GZ8MTXP02I29OB.51.6.A06.1.454.CMB.2.raw
  modified_base (352)..(352): a, c, t, g, unknown or other
  misc_feature (352)..(352): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagtcttcagtacgtatggtttgcgctgggtcccgcaggctccaggcaaggggctgcaggtgggtgcatctatatcatatgaaaggaancaaataaatacacgcagactcgtagaggcatacacntcncaganacacaccaaanaacactactttanactagaacaaatacgaacacctagagtacgtgaagacgacgtctagtactattacgtggtagacgaaggagggaagacgtacgactacgacgacg

SEQ ID NO: 322948 - DNA, 492 bp, Homo sapiens
  misc_feature: GZ8MTXP02GQU9L.51.6.A06.1.454.CMB.2.raw
  modified_base (407)..(407): a, c, t, g, unknown or other
  misc_feature (407)..(407): n is a, c, g, or t
  modified_base (428)..(428): a, c, t, g, unknown or other
  misc_feature (428)..(428): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccatattcttatggtaccagcagaagccaggccaggcccctgtgttgttgatatataaagacactgagaggccttcagggatccctgagcgatctctcggctccactcagggacaatggtcacattgaccatcagtgagtccaggcagaagacgaggctgactattctagtcaaatcttnagacatcagtgtacttatgtntcgaactgggacaaggtcacgtcctaggtcaacgcccaaggtccaacccactcgtcactctccg

SEQ ID NO: 322949 - DNA, 623 bp, Homo sapiens
  misc_feature: GZ8MTXP02GM6CM.51.6.A06.1.454.CMB.2.raw
  modified_base (388)..(388): a, c, t, g, unknown or other
  misc_feature (388)..(388): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctccccctcctcactctctgcacaggctctgaggcctcctatgtgctgacacagcccaccctggtcgtccgtgtccccaggacagacggccaggactcacctgctcgtggagatgtattcgcccaaccctactattcttattcggtaccagacagaacgccgaaggccacggcccctgtcgtttgtgattaatataaagacacctgagaggtccttagagggactcccgtgacgcgtattccnctcggccctccgaccctacgaaggggaaccaagttcgggtaccacgtacttacgaaccctagtacgaaggttcggaacgtcccgaagggacgaagggaaacggacgaaggtccgtaggtaaccttagtttccgtagtacctaaattccttcgaaagtacctataccgtaggtacggtttaacttaagttacgttacgttacgggtaacgtacggggtaacctaaacggttccccg

SEQ ID NO: 322950 - DNA, 503 bp, Homo sapiens
  misc_feature: GZ8MTXP02JUHLK.51.6.A06.1.454.CMB.2.raw
  modified_base (230)..(230): a, c, t, g, unknown or other
  misc_feature (230)..(230): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccntattcttattggtaccagcagaagccaggccaggcccctgtgttgttgatataataaagacactagagaggccttcagggatccctgacgcgtagttctctcggctccacctcgacgggacaatggtcactattgaccatcagtggagtccaggcagaagacgaggctgacttattctgtcaatctcagacatcagtgtactatgtcttacgaactcggactaaggtcaccgtcgtagtcagcccgaagcccaaccactgtaccactctcccg

SEQ ID NO: 322951 - DNA, 722 bp, Homo sapiens
  misc_feature: GZ8MTXP02JWE4V.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgacccaacccatattcttattggtaccagcagagcaggccaggccctgtgtgttgatatataaagacactgagaggccttcgagggactccgtgagcgtattctctggctccacctcgagggacaagtcggtacactattcgaacctaagtccaaaggtcgggacgttacccgaagggacaaaggaaaggacggaacgggcctaggtaaccttaagttttcctaggtactaaaacttcgtttaccgaagttaaccaagttacctaaacgggtttggggtttaaacctttaaacggttggtttaccgttttaaccgggggaaaacggtttcggggggaaaaccccgttaaaacgggggtttcccaaacccccggggtttacccgtttaaaacgggggtccctaaaccggggtaccccccgtaaaaacgggggtacccccctaaaacccccccgaaaccgttaccgggtttaccccctacccgtttaccccgtttaccccgg

SEQ ID NO: 322952 - DNA, 519 bp, Homo sapiens
  misc_feature: GZ8MTXP02J2R0L.51.6.A06.1.454.CMB.2.raw
  modified_base (327)..(327): a, c, t, g, unknown or other
  misc_feature (327)..(327): n is a, c, g, or t
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctggggaggtccctgagactctcctgtgaagcctctggattcagcttcagtacgtatggtttgcgcgtgggtcccgccaggctccaggcaagggctgcagtgggngcatctatatcatatgaaaggancaaataaactcacgnagactcgagacggcatcacntcacaganacacaccaanacactacttanctagacaaatcgaaaccaccgtagacgtacgtaggaacgacgacggtctgtacttaatttacgtacggtgacggaaggacgggtagacgtacgactacaacgacg

SEQ ID NO: 322953 - DNA, 517 bp, Homo sapiens
  misc_feature: GZ8MTXP02HAAWD.51.6.A06.1.454.CMB.2.raw
  modified_base (415)..(415): a, c, t, g, unknown or other
  misc_feature (415)..(415): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgtgatatataaagacactgagaggccttcgagggatccctgacgcgtattctctcggctccactcgagggacaagtggtcactattcgaccatcaagtgagtccaggcagaagacgaggctagactattcagtcaatctnagacatcaggtgtacttagtgtacttacgaacgtcgggacctaaggtcaccgtcgtacggtccacgacccaaggcccaacccactcgacctacgtccttccg

SEQ ID NO: 322954 - DNA, 619 bp, Homo sapiens
  misc_feature: GZ8MTXP02HCJVM.51.6.A06.1.454.CMB.2.raw
  modified_base (256)..(256): a, c, t, g, unknown or other
  misc_feature (256)..(256): n is a, c, g, or t
  modified_base (495)..(495): a, c, t, g, unknown or other
  misc_feature (495)..(495): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccaggcctggggacgtcctgagctctctgtgagcctntggattcagtcttcagtacgtattggttgcgtcgtgggtcccgccaggcctccgaggcgaagggctggcgaggtgggtgcagtctatatcaatagtaggaaaggaagctaaaattaaactcgtaacgcaacgtaccttacccgggtaaggaacggggtaccctattaccgaacctaacgttcctaccgaagaacgaaacaaaccgtaccccaaaagaaaccctaacttaaccttttaanaccgtaacgaaactaaacgtacgaaacctaccgtaggaacgtacgtacgacgacgtacggtctacgtacttaagttacgtacgtaggacggaaggacggtacgtacgtacgactacgaacgacg

SEQ ID NO: 322955 - DNA, 523 bp, Homo sapiens
  misc_feature: GZ8MTXP02JK25O.51.6.A06.1.454.CMB.2.raw
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (395)..(395): a, c, t, g, unknown or other
  misc_feature (395)..(395): n is a, c, g, or t
  modified_base (426)..(426): a, c, t, g, unknown or other
  misc_feature (426)..(426): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctggggaggtccctgagactctcctgtgaagcctctggattcagcttcagtacgtatggtttgcgctgggtccgcaggctccgaggcaagggctgcaggtgggtgcatctatatcatatgaagaancaaataaanactacgacaagactccgtagagggccattcacatccnccagacacaactccaaagaacactactttanctagtacaaaagtcgaaacctacccgtgaacgtactagaacggacacgggtctagtactattagttgtgacgaagagggtacagtcgatacacgacg

SEQ ID NO: 322956 - DNA, 507 bp, Homo sapiens
  misc_feature: GZ8MTXP02JUBP1.51.6.A06.1.454.CMB.2.raw
  modified_base (434)..(434): a, c, t, g, unknown or other
  misc_feature (434)..(434): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcagggatccctgagcgattctctcggctccacctcagggacaatggtcacattgacatcagtgagtccaggcagaagacgaggctgactagttctagtcaaatcttacagacatcagtggtacttatgtnttcgaacttcgggaccaaggtcaccgtctacggtcacgcccaacggccaaccccactcgtccacgtcttaccg

SEQ ID NO: 322957 - DNA, 540 bp, Homo sapiens
  misc_feature: GZ8MTXP02IT7G0.51.6.A06.1.454.CMB.2.raw
  modified_base (294)..(294): a, c, t, g, unknown or other
  misc_feature (294)..(294): n is a, c, g, or t
  modified_base (383)..(383): a, c, t, g, unknown or other
  misc_feature (383)..(383): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctggggagtccctgagactctcctgtgaagcctctggattcagcttcagtacgtatggttgcgctgggtccnccaggctccaggcaagggctgcagtgggtgcatctatatcatatgaaggaagcaaagtaaatctacgcagactcgtagacggcatcacntactcagacgacaatcccaaanaactactactttanactanacaaatacgaactaccgtagacgtacgtagacgtacgacggtcttacgtacttaacttacgttcggtacggacggtaagggacggggaacgtacgtacggtaactacgaacgacgg

SEQ ID NO: 322958 - DNA, 514 bp, Homo sapiens
  misc_feature: GZ8MTXP02HUJH6.51.6.A06.1.454.CMB.2.raw
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatcctctacttctccccctcctcactctctgcacaggctctgaggcctcctatgtgctgacacagccaccctcggtgtccgtgtccccaggacagacggccaggatcacctgctctggagatgcattcgacccaacccactattcttattggtaccagcagaagccaggccaggcccctgtgttgtgatatataaagaccatagagaggtcttcagggtctcccgtagagcgtattctctgcctccacctcgacgggacaagtgtacactatcgaccatcagtggacgtcgagcgagaagacgagcngactattnagtacaattctacagactatactagttacgtaatttactacgttcttacggactacggaactaacgg

SEQ ID NO: 322959 - DNA, 487 bp, Homo sapiens
  misc_feature: GZ8MTXP02FTSAB.51.6.A06.1.454.CMB.2.raw
  modified_base (298)..(298): a, c, t, g, unknown or other
  misc_feature (298)..(298): n is a, c, g, or t
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (419)..(419): a, c, t, g, unknown or other
  misc_feature (419)..(419): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgagcctctggattcagcttcagtacgtatggtttgcgtcgtgggtcccncaggctccgaggcaagggactgcaggtgggngcatctatatcatatgaaaggancaaataaatactacgcagactcgtagaggccatcacntcncaganacatccaaagacactactttanctagacaaatgaacnccctaganactgagacacgctgtctatattgngngaagaganangacncanag

SEQ ID NO: 322960 - DNA, 563 bp, Homo sapiens
  misc_feature: GZ8MTXP02GAM3A.51.6.A06.1.454.CMB.2.raw
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (355)..(355): a, c, t, g, unknown or other
  misc_feature (355)..(355): n is a, c, g, or t
  modified_base (462)..(462): a, c, t, g, unknown or other
  misc_feature (462)..(462): n is a, c, g, or t
  modified_base (547)..(547): a, c, t, g, unknown or other
  misc_feature (547)..(547): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggacgtccctgagactctctgtgagcctntggattcagcttcagtacgtatggttgcgtcgtgggtccncgaggcctccgaggcaagggctgcaggtgggngctatctatatcatataggaaaggaancaaaataaactactacgactaacgaccgtcgtaggaacgggccgtaattccgaacctattccaccgaagaacgaacaaacgtacccaaaagtaaccaactactttanctagaactaaaagtcgaaacctacccgtagaactacgtaggaacgacgacggtctcgttactattacgttgtgacgaaggagganacgtcgatcgaacacg

SEQ ID NO: 322961 - DNA, 620 bp, Homo sapiens
  misc_feature: GZ8MTXP02H6BH7.51.6.A06.1.454.CMB.2.raw
  modified_base (258)..(258): a, c, t, g, unknown or other
  misc_feature (258)..(258): n is a, c, g, or t
  modified_base (303)..(303): a, c, t, g, unknown or other
  misc_feature (303)..(303): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccagccgtgggagtcctgagactctctgtgacgcctgnggattcagtcttcagttacgtagtggtttcgcgtcgtgggtcccncgaggcctccgaggcaaaggggctggcgaggtgggtgcatctatatcatagtagaaggaagcaaaattaaaatacgtaacgacacggaactccggtagaaacggggccctaaacttcccgaaccacttaccccgaacgaacgaacgaaacctaccgaaccgaaactaacctaactttaactttacacgtacaaactaaagtaaccgtaaaccctacgtaagtaacgtacgttaacgggaccgtaacgtacgtccgttagttaacttacgttacgtagtcggaacgtaagggaacggaatacggactacgacacgacg

SEQ ID NO: 322962 - DNA, 492 bp, Homo sapiens
  misc_feature: GZ8MTXP02JIDGY.51.6.A06.1.454.CMB.2.raw
  modified_base (296)..(296): a, c, t, g, unknown or other
  misc_feature (296)..(296): n is a, c, g, or t
  modified_base (354)..(354): a, c, t, g, unknown or other
  misc_feature (354)..(354): n is a, c, g, or t
  modified_base (385)..(385): a, c, t, g, unknown or other
  misc_feature (385)..(385): n is a, c, g, or t
  modified_base (415)..(415): a, c, t, g, unknown or other
  misc_feature (415)..(415): n is a, c, g, or t
  modified_base (438)..(438): a, c, t, g, unknown or other
  misc_feature (438)..(438): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccncaggctcgaggcaagggctgcagtgggtgcatctatatcatatgaagagcaaataaanactacgcagactcgtgaaggcgatcacatcnccagagacaatcccaaagaacacactttanctagacaaatgaacaccctaganactgaggtacacggctgtctattactgtgacgaagaggacgatcgactcgacag

SEQ ID NO: 322963 - DNA, 584 bp, Homo sapiens
  misc_feature: GZ8MTXP02IXB7T.51.6.A06.1.454.CMB.2.raw
  modified_base (430)..(430): a, c, t, g, unknown or other
  misc_feature (430)..(430): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaacccacttatttcttattcggtaaccagcagaagccaggccacggccctgtgttgtgatataataaagacactgagacggtccttacgagggtactcccgtgacgtcgtattcgtcgtcggcctaccacctcgagggacaatcggtacatattcgaccatcgagtggactccgagcaagtaagacgagctacgaattattntagtacaaacttcttagaagactatacgtaggttacgttacttagttcgtacgttacggaagtacgggaacgtacggtacctaccgttaccgtacggtaccaccgaacccgaacggacccccaaaccctacgtcgtacctaccgtccttacccg

SEQ ID NO: 322964 - DNA, 644 bp, Homo sapiens
  misc_feature: GZ8MTXP02IPXZR.51.6.A06.1.454.CMB.2.raw
  modified_base (295)..(295): a, c, t, g, unknown or other
  misc_feature (295)..(295): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggagtccctgagactctctgtgagcctctggattcagcttcagtacgtatggttgcgcgtgggtccncgaggctccgaggcaaggggctgcgaggtgggtgcagtctatatcaatagtaggaaaaggaacgactaaattaaaactaacgtaccgacgaaagaccttccggtaggaacggggccctaattccaacctatcctaccgaagacgaaccaaactacccaaaagaacctaaacctacttttactactagaactaaaacgtcgaaaccctacccgttaggacgtaacgtttagggaacgggaaccgtacgggtactttacggtttaacctttaaagttttaacgttcgggttacggacggggttaaaggaacgggggtaactaaacgttcggaaaacgtcaaaccgaaccgg

SEQ ID NO: 322965 - DNA, 523 bp, Homo sapiens
  misc_feature: GZ8MTXP02JWK42.51.6.A06.1.454.CMB.2.raw
  modified_base (510)..(510): a, c, t, g, unknown or other
  misc_feature (510)..(510): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgcattgccaacccatattcttattggtaccagcagaagccagccaggcccctgtgttgttgatataataaagacactgagaggccttcgagggatccctgagcgtattcctctggctccacctcagggacaatggtcacattgaccatcagtggagtcaggcagaagacgaggctgactattctagtctaatcttagagacatcagtcggtacttatgttcgtttacggaacgtggggacctaaaggtcctaccgtccgtaggtcaacgcccgaaacggcccaaacccnctcgtactacccg

SEQ ID NO: 322966 - DNA, 551 bp, Homo sapiens
  misc_feature: GZ8MTXP02FQMXF.51.6.A06.1.454.CMB.2.raw
  modified_base (231)..(231): a, c, t, g, unknown or other
  misc_feature (231)..(231): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccntattcttatggtaccagcagaagccaggccaggcccctgtgttgttgatatataaagacactgagaggccttcagggatccctgagcgattctctcggcctccactcgagggacaagtcggcactattcgacctatcagtgagtccgagcagaagacgagctagacgttattctagtcaattcttacagacatcgagtgtactttagtcgtacgttacggaactacgggactaacgggtaccacccggttacctacggttccacggtaccccgaaacgggccccaaaccccgacttccggtacctacctcctttaccccg

SEQ ID NO: 322967 - DNA, 536 bp, Homo sapiens
  misc_feature: GZ8MTXP02G4399.51.6.A06.1.454.CMB.2.raw
  modified_base (413)..(413): a, c, t, g, unknown or other
  misc_feature (413)..(413): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaaccactattcttattggtaccagcagaagccaggccaggcccctgtgttgttgatatataaagacactgagagccttcagggatccctgagcgattctctcggcctccacctcagggacaagtggtcacattcgaccatcagtgagtccgagcagaagacgaggctgactatttctgtcaatcttnagacatcagttggtacttatgttcgttacggacgtacgggtaccaaggtcctaccgtaccgtacgtaccgacgacccgaacggcccctaaaccccgacttcggtacctacctcgtttaccccg

SEQ ID NO: 322968 - DNA, 595 bp, Homo sapiens
  misc_feature: GZ8MTXP02GD0BK.51.6.A06.1.454.CMB.2.raw
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
  modified_base (453)..(453): a, c, t, g, unknown or other
  misc_feature (453)..(453): n is a, c, g, or t
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggtttgcgctgggtccncaggctccgaggcaaggggctgcaggtggngatagtactagtactcatagtaggaaagaagacaaataaatccgtaacgcgaacgtaccgtaccggtagggaacggtaccgtacttaccaacctatacctaccgaaggaacaacaactacccgaaaanaacctaactacttanacgtanaactaacgtacgaacctaccgtagacgtacgtacgaacgtaccgtacggtactacgttacttagtttacgtacggtacggacggtaaggtaacgggaacgtacgtacgactacgaacgacg

SEQ ID NO: 322969 - DNA, 794 bp, Homo sapiens
  misc_feature: GZ8MTXP02H82SF.51.6.A06.1.454.CMB.2.raw
  modified_base (198)..(198): a, c, t, g, unknown or other
  misc_feature (198)..(198): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtncagtcgtgggggagcgtggtccagcctgggaggtccctgagactctcctgtgaagcctctggattcagcttcagtacgtatggtttgcgtctggggtcccgccaggcctccgaggcaaaggggctggtaggtggggtgcagtctagtactcaattataggaaaggtaagactaaagttaaaaacttactaaaccggacctaacggaacctttaccccgggttaagggaaaacggggggtcccctaaacggttttacccgaaaccccttaaacgttaccctttaacccccgaaagggtaaaccggaaaccccaaaaacccgtttacccccccaaaaaaggaaaaacccctaaccttaaaacccttttttaacgtacctttacggaaccttaaaaaacttaccggaaaaacccctaacccccgttaggaaacgttaaaccgtttacgggaaaacgggtaaacccgaaccgggggtacctttacggtttaccctttaaagttttaaacgtttcgggttacggtaaccggtaaaaggggtaagggggaagtaaaacggtaccggtaaaaggttacccaaaaccgtaacggtaacccccgg

SEQ ID NO: 322970 - DNA, 627 bp, Homo sapiens
  misc_feature: GZ8MTXP02G213G.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagcccaccctcggtgtccgtcgtccccaggacagacggccaggatcacctgctctggagatgcattcgacccaacccactattcttattggtaccagcagaagccaggccaggcccctgtgttgtgatatataaagaccactgagaggccttcgaagggtctcccgtgacgcgtatttcgtctcggcctcccaccctacgaacggggaacaaagttcggtaccactagtttacgaaccctagtaccgaggttagggaacgttccgaagggaccgaaaggaaacggaaccggtaaggtccgtaggtaacctttaagttttccgtaacggttactaaaacgtttcctttaccgaaaggtacctagttaccgtaaggtttaggttaacctttgtacgttacgttacggtaaacgttcggggaaccttaaaccggg

SEQ ID NO: 322971 - DNA, 591 bp, Homo sapiens
  misc_feature: GZ8MTXP02GEWYP.51.6.A06.1.454.CMB.2.raw
  modified_base (189)..(189): a, c, t, g, unknown or other
  misc_feature (189)..(189): n is a, c, g, or t
  modified_base (300)..(300): a, c, t, g, unknown or other
  misc_feature (300)..(300): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (445)..(445): a, c, t, g, unknown or other
  misc_feature (445)..(445): n is a, c, g, or t
  modified_base (460)..(460): a, c, t, g, unknown or other
  misc_feature (460)..(460): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcagtcgtgggggagcgtggtccagccgtgggagtccctgagctctcctgtgaagccctctggattcgagcttcagtacgtatggtttgcgtcgtgggtcccncgaggcctccgaggcaagggctgcaggtggtgcatctatancaatagtagaaaggaanactaaataaagtactacgcaagacctccggtagaaacgggtcctaattccaacctatcctaccaagaagaaccaaactcccgaaaanaacaacttactttanacgtagaactaaaacgtacgaaacctaccgtagacgtaacgtaggaacggactacggtcttacgtactttaagttgttacggacggaacggaagggtacgggtaacgtacgtacggtaacacgtaacgacg

SEQ ID NO: 322972 - DNA, 543 bp, Homo sapiens
  misc_feature: GZ8MTXP02FMD48.51.6.A06.1.454.CMB.2.raw
  modified_base (297)..(297): a, c, t, g, unknown or other
  misc_feature (297)..(297): n is a, c, g, or t
  modified_base (443)..(443): a, c, t, g, unknown or other
  misc_feature (443)..(443): n is a, c, g, or t
  modified_base (490)..(490): a, c, t, g, unknown or other
  misc_feature (490)..(490): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtgcaggtcgtgggggaggcgtggtccagcctgggagtccctgagctctcctgtgaagcctctggattcagcttcagtacgtatggttgcgcgtgggtccncgaggctccgaggcaagggctgcaggtgggtgcatctatatcaatagtagaaggaatcaaataaatacgtacgactaggacctccggagaacggggccattcactatcaccagacacaaactcccaaaagaccactacgtttaacnctagaacaaactacaaccacgtagactacgtaggacgacgtacggtntacgttattattacgtcgaggacggaaggaggactacgtacgacacgacgacg

SEQ ID NO: 322973 - DNA, 501 bp, Homo sapiens
  misc_feature: GZ8MTXP02GE0QU.51.6.A06.1.454.CMB.2.raw
  modified_base (402)..(402): a, c, t, g, unknown or other
  misc_feature (402)..(402): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagagccaggccaggcccctgtgttgtgatatataaagacactgagaggccttcagggatccctgagcgattctctcggctccgacctcgaggggaccaatcgggtcacattcgaccatcagtgagtccagcagaagacgagctgactattcngtcaatcttcagacatcagtgtacttatgtctgaactggacaggtcaccgtctacggtcacgcccaaaggcccaaacccactcgtacacctcttacccg

SEQ ID NO: 322974 - DNA, 597 bp, Homo sapiens
  misc_feature: GZ8MTXP02HD8H1.51.6.A06.1.454.CMB.2.raw
tcagcgatcgtatacacgaccggtgctcgatttagatctactgacagaggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagactctcctgtgaagcctctggattcagcttcagtacgtatggtttgcgcgtgggtccgccaggcctccgaggcaaggggctgcgaggtggggtgctatcctatatcatataggaaaggagacaaataaactactaacgcaagtacctaccggtaggaaacggccgaagttccaacctacttcctaccaagacgaacaaactacccgaaagaaaccaactaactttaatactaaagaaaactacgaaacctacccgtagaacgtaccgttaggaacggaaccgtacgggtacttacggtactaactttacgttacggtagtacggaaggaaggggacgtagtacggactacgaacgacg

SEQ ID NO: 322975 - DNA, 515 bp, Homo sapiens
  misc_feature: GZ8MTXP02GXD8W.51.6.A06.1.454.CMB.2.raw
  modified_base (295)..(295): a, c, t, g, unknown or other
  misc_feature (295)..(295): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (428)..(428): a, c, t, g, unknown or other
  misc_feature (428)..(428): n is a, c, g, or t
  modified_base (447)..(447): a, c, t, g, unknown or other
  misc_feature (447)..(447): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggaggtccctgagactctcctgtgaagcctctggattcagcttcagtacgtatggttgcgctgggtccnccaggctccgaggcaagggctgcgagtgggtgcatcatatcatatgaagancaaataaanactacgcaagactcgtagaacgggccatcacatctaccagaacgacaaactcccaaaagaaccactactttanactagaccaaatgaaaccncctagagtacttagacggacacggctagtactattacgtgtgacgaaggacggagatcgatcaacacg

SEQ ID NO: 322976 - DNA, 507 bp, Homo sapiens
  misc_feature: GZ8MTXP02JN0CC.51.6.A06.1.454.CMB.2.raw
  modified_base (412)..(412): a, c, t, g, unknown or other
  misc_feature (412)..(412): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctcggctccacctcaggggacaatggtcacattgaccatcagtgagtccagcagaagacgaggctagactatttctgtcaatcttnagtacatcagtggtacttatgtcttcgaactcgggacaaggtcaaccgtctaggtcacgacccgaaggcccaaacccgctcgtccactcttcccg

SEQ ID NO: 322977 - DNA, 505 bp, Homo sapiens
  misc_feature: GZ8MTXP02JKXRK.51.6.A06.1.454.CMB.2.raw
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccagccaggcccctgtgtgttgatatataaagacactgagaggcttcagggatcccgtgagcgattctctggcctccacctcgagggaccaatggtcacaattgaccatacagtgagtccaggcagaagacgaggtcnggactatttcngtcaatcttcgatacatacagtaggtaacttatacgtcttacggaactacgggactaaacgg

SEQ ID NO: 322978 - DNA, 649 bp, Homo sapiens
  misc_feature: GZ8MTXP02IDH1M.51.6.A06.1.454.CMB.2.raw
  modified_base (290)..(290): a, c, t, g, unknown or other
  misc_feature (290)..(290): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaacccatattcttattggtaccagcagaagccaggccacggcccctgtgttgttgatataanaaagacactgagaggtccttgaggtactcccgtgagcgtattcgtctcggcctacccacctcgaagggacaatcggtacaactagttcgaaccctatactaggtagacgcccgaagggccaaaggaaacgacggaagggtcctaggtaaccttatttcgtacggttaactaaattcctttaacaaggtacctaatcgtaaggtttggttaacctttagtcgttaccgtttacgggaaaacgttcggggtaaaaccgtaacgggtacctaaacccggttccgtttaaacgggcccgtaaaccgccccgtaaaacggccccctaaaaccccgtacgtcctaccgacctttacgttcccccg

SEQ ID NO: 322979 - DNA, 534 bp, Homo sapiens
  misc_feature: GZ8MTXP02HWFX3.51.6.A06.1.454.CMB.2.raw
  modified_base (472)..(472): a, c, t, g, unknown or other
  misc_feature (472)..(472): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagaccactgagaggcctttcgagggctcccgtgacgcgtattctctcgggcctcccacctcgagggacaaagttggtcactattcgaccctataccgagttgggagttacccgaggccaagaaagacgagggctagactatttcgngtacaattcttacagactatcagtggtaacttagtgttactcggtaactcgggactaaacgg

SEQ ID NO: 322980 - DNA, 656 bp, Homo sapiens
  misc_feature: GZ8MTXP02HADS8.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatcacctgctctggagatgcattcgacccaacctatattcttattcggacccagcagaacgccaggccacggcccctgtcgttgttagataataataaagacacgtagaggtacggccttacgagggtactcccgtagacgcgtattcgtcgtcggcctccaccgtcgacgggaacaagtcggtacacgtattacgaaccctagtaccaaaggttcgggaacgtacccgaagggaccgaaaggaaaacgggacggaaacggtccgttaaggtaaccctttaagttttctacggttaacctaaaacgtttccgtttaacaacggtaactaacgtacgtaggtttaggttaacctttaagtcgttacgttacgggtaacgttcgggaacctagggtccctaacgtacgtacgggtccacgacccgaacgcccaaacccgctctacctactccgttccccg

SEQ ID NO: 322981 - DNA, 555 bp, Homo sapiens
  misc_feature: GZ8MTXP02JH6SJ.51.6.A06.1.454.CMB.2.raw
  modified_base (302)..(302): a, c, t, g, unknown or other
  misc_feature (302)..(302): n is a, c, g, or t
  modified_base (360)..(360): a, c, t, g, unknown or other
  misc_feature (360)..(360): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtgggaggtccctgagactctcctgtgaagcctctggattcagcttcagtacgtatggtttgcgtcgtggggtccncaggcctccgaggcaaggggctggcaggtgggtgcagtctatatcatatgaaaggaanctaaataaactacacgacagactcgtagacggcctatacactactcaccaagacacaactaccaaanaacactacttanactanaacaaatacaacctaccgtagacgtactaggaacggacgacggtactacgtacttaattacgttcgtaggacggaagggtaacggtacgtacgtacgaactaccgacgacg

SEQ ID NO: 322982 - DNA, 616 bp, Homo sapiens
  misc_feature: GZ8MTXP02IYTYO.51.6.A06.1.454.CMB.2.raw
  modified_base (218)..(218): a, c, t, g, unknown or other
  misc_feature (218)..(218): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattcgcccaacccactattcttattggtaccagcagagccagccaggcccctgtgttgtgatatataaagacactgagacggcctttacgagggtactcccgtagagcgtattccctcgtggcctacccacctcgaagggaccaaagtcggtacactattcgaaccatcgagtggacgtaccgaggacaagaacgacgaggctagacttattcgtgtactaatccttacaagactatacgtaagttacggttactttaagtcgttacgttaccggtaacgttacgggaaccgtaaaggttccctaaccggttaccgttacgggttaaccaacgggaacccccgtaaacgggtacccccaaaacccccgttacgtaccggtttaccctaaacccg

SEQ ID NO: 322983 - DNA, 580 bp, Homo sapiens
  misc_feature: GZ8MTXP02ITK84.51.6.A06.1.454.CMB.2.raw
  modified_base (171)..(171): a, c, t, g, unknown or other
  misc_feature (171)..(171): n is a, c, g, or t
  modified_base (295)..(295): a, c, t, g, unknown or other
  misc_feature (295)..(295): n is a, c, g, or t
  modified_base (330)..(330): a, c, t, g, unknown or other
  misc_feature (330)..(330): n is a, c, g, or t
  modified_base (353)..(353): a, c, t, g, unknown or other
  misc_feature (353)..(353): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagnggtgtccagtgtcaggtgcagctggtgcagtcgtgggggagcgtggtccagcctggggagtccctgagctctctgtgagcctctggattcagtcttcagtacgtatggttgcgcgtgggtcccncaggcctccgaggcaagggactgcgaggtgggtgnatctatatcatatagaaaggaancaaataaaatactacgacagacgtaccgtaggaacggccgattccacatacctaccagaacgaaccaaacgtacccaaaagaaaccctaactaacttttactacgttacgaacctaaaagtacgaaaccacccgtagacgaccgttagacggaacacgggtaccttagttacttagtttacgttacgtaggtacgaaggagggaacgtagtacggatacaacgaacg

SEQ ID NO: 322984 - DNA, 539 bp, Homo sapiens
  misc_feature: GZ8MTXP02GOBI2.51.6.A06.1.454.CMB.2.raw
  modified_base (416)..(416): a, c, t, g, unknown or other
  misc_feature (416)..(416): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgtgatatataaagacactgagaggccttcgagggactccctgagcgattctctcggctccactcaggacaatgtcacattgaccatcagtgagtccagcaagaagacgaggctgactattcgtagtctaaatctttacaanactatacgtagtagttacttagttagttacgtacgtaacgtacggtacgtacgtaccgtaccgtaccgtacgtacgaccgaccgaaccgacccgaacccacctacgtacctacctaccgtccg

SEQ ID NO: 322985 - DNA, 515 bp, Homo sapiens
  misc_feature: GZ8MTXP02I7O5A.51.6.A06.1.454.CMB.2.raw
  modified_base (414)..(414): a, c, t, g, unknown or other
  misc_feature (414)..(414): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgtgatatataaagacactgagagccttgaggatccctgagcgattctctcggctccacctcagggacaatggtacacattacgacctatcagtgatccaggcaagaagagaggctagactattctagtcaaattcttanagactatcagtagtacttagtgtactcgaacttcgggacaagggtccaccgtcgtacgtccacgacccaaggcccaaacccgtacgtctaccactctcccg

SEQ ID NO: 322986 - DNA, 592 bp, Homo sapiens
  misc_feature: GZ8MTXP02FPPCA.51.6.A06.1.454.CMB.2.raw
  modified_base (262)..(262): a, c, t, g, unknown or other
  misc_feature (262)..(262): n is a, c, g, or t
  modified_base (351)..(351): a, c, t, g, unknown or other
  misc_feature (351)..(351): n is a, c, g, or t
  modified_base (387)..(387): a, c, t, g, unknown or other
  misc_feature (387)..(387): n is a, c, g, or t
  modified_base (463)..(463): a, c, t, g, unknown or other
  misc_feature (463)..(463): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtggggaggtccctgagactctcctgtgaagccctntggattcagcttcagtacgtatggtttgcgcgtcggggtcccgccagggcctccgaggcaaggggctgcaggttggggtgcatctatancaatatggaaaaggaagcaaaataaaactcctacgnaagacctccggtaggaaacgggcctattccaccatccaccaaggacacaaactccccaaagaaccactactttaancctagacaaaactgaaaccacccgtagaacgaacgttaggaacggaccacgggtcttagttacttaagtttacgttggtacgacgggaaagggaaggggaacgtacgtaccggaatacccaacgaacgg

SEQ ID NO: 322987 - DNA, 532 bp, Homo sapiens
  misc_feature: GZ8MTXP02I8IYC.51.6.A06.1.454.CMB.2.raw
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (517)..(517): a, c, t, g, unknown or other
  misc_feature (517)..(517): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaacccacttattcttattggtaccagcagaagccaggccaggcccctgtgttgttgatatataaagacactgagaggccttcgagggactccctgacgcgtattctctcggcctccacctcgagggaccaagtcggtacacattcgaccatcagtgagtccgaggcagaagacgagctgactattctagtaaatctacgananatacgagtaggtacttatgtcttacgacgtggaacagtcacgtaccgtaggtccacgcccgaacggcccaacccgactcgtaccnctactcgttcccccg

SEQ ID NO: 322988 - DNA, 549 bp, Homo sapiens
  misc_feature: GZ8MTXP02GK8PC.51.6.A06.1.454.CMB.2.raw
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgacccaacccatattcttattggtaccagcagaagccagccaggccctgtgttgtgatatataaagacactgagaggccttacgaggactccctgacgcgattctctcggctccactcgaggacaagtggcacattgaccatcagtgagtccaggacagaagacgaggctagactattctagtnaaattcttanagtacatacagtgttactattgtacgttacggaacgtacgggacctaagggtacccaaccggttccgtaacggtaccgaacgaccccgaaacggaccccaaacccctactaccgtccaaccttccgttacccg

SEQ ID NO: 322989 - DNA, 541 bp, Homo sapiens
  misc_feature: GZ8MTXP02JES84.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgaccaacccactattcttattggtaccagcagaacgccaggccaggcccctgtgttgttgatatataaagacactgagaggtccttcgagggactcccgtgagcgtattctctcggcctccactcgagggacaagtggtcactattacgaccatcagtgatccgagcagaagacgagctagacttattctagtactaattctacagtacatctagtgttacttagtgtacgttacggaacgttcggaacgtaggtccgtaccgtacgtacgtaccacgacccaacggcccaaccctacgtcgtactacctcgttcccg

SEQ ID NO: 322990 - DNA, 553 bp, Homo sapiens
  misc_feature: GZ8MTXP02IS50L.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagcccaccctcggtcgtccgtgtccccaggacagacggccaggatcacctgctctggagatgcattgcccaacccacttattcttattcggtaccagccagaacgccaggccaggcccctgtgttgttgatataaataaagaccactgagacggccttacgagggctccctgacgtcgtattctcgtcggcctccacctcgaacgggactaaagtcggtacaactattcgaccatacgagttggaacgtccgaggacagaaacgcgaggctagtactatttcgtgtaccaattcttcaagacctatacgagttggttaacttagtcgttacgttcggaacgttcgggaaccgtaacgg

SEQ ID NO: 322991 - DNA, 585 bp, Homo sapiens
  misc_feature: GZ8MTXP02GG2C0.51.6.A06.1.454.CMB.2.raw
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (332)..(332): a, c, t, g, unknown or other
  misc_feature (332)..(332): n is a, c, g, or t
  modified_base (460)..(460): a, c, t, g, unknown or other
  misc_feature (460)..(460): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctggggagtccctgagactctcctgtgagcctctggattcagtcttnagtacgtattggttgcgtcgtgggtccnccgaggctccgaggcgaagggctggcaggtgggngcattctatatcaatagtaggaaaggagacgtaaaataaactacgtacgcaagtacgtcccgtaggaacggcccgtattaccgaactagtctaccagacgaacaactacccaaagaccactactttanacgtagaacaaagtacgaacaccgtagagtaccgttaggaacggtaaccgacgggtcttacgtaccttaactttacgttcggtagacggaaggtacggggaatacgtacgaactacgacgaacgg

SEQ ID NO: 322992 - DNA, 537 bp, Homo sapiens
  misc_feature: GZ8MTXP02H39C3.51.6.A06.1.454.CMB.2.raw
  modified_base (297)..(297): a, c, t, g, unknown or other
  misc_feature (297)..(297): n is a, c, g, or t
  modified_base (452)..(452): a, c, t, g, unknown or other
  misc_feature (452)..(452): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgaagcctctggattcagcttcagtacgtatggtttgcgctggggtcccncgaggctccgaggcaaggggactggtaggtggggtggctagtctatactcatatgaaggaagactataaaatactaccggacaagacctcgtagaaacggggccgattccaccatctaccagacgacaactcccaaagaacactactttatctanacaaatcgaacaccctgaacgtacttgacggacacggctgtactattattcgtagcgaggaagggagattcgatacacgacgacg

SEQ ID NO: 322993 - DNA, 509 bp, Homo sapiens
  misc_feature: GZ8MTXP02IL5SB.51.6.A06.1.454.CMB.2.raw
  modified_base (255)..(255): a, c, t, g, unknown or other
  misc_feature (255)..(255): n is a, c, g, or t
  modified_base (349)..(349): a, c, t, g, unknown or other
  misc_feature (349)..(349): n is a, c, g, or t
  modified_base (388)..(388): a, c, t, g, unknown or other
  misc_feature (388)..(388): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
  modified_base (464)..(464): a, c, t, g, unknown or other
  misc_feature (464)..(464): n is a, c, g, or t
  modified_base (480)..(480): a, c, t, g, unknown or other
  misc_feature (480)..(480): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggagtccctgagctctctgtgagcctnggattcagcttcagtacgtatggttgcgcgtgggccgcgaggctccgaggcaagggctgcgaggtgggtgcagtctatatcatatagaaaggancaaataaactacacgcagactcgagaaggcatcacatcncagacacanccaaanacactactttanctagaacaaatacgaacctaccgtagagtacgttagacggacacgggtntacgtattactgtcgngacgaagaggagtactacgactacacgcg

SEQ ID NO: 322994 - DNA, 523 bp, Homo sapiens
  misc_feature: GZ8MTXP02I66LC.51.6.A06.1.454.CMB.2.raw
  modified_base (400)..(400): a, c, t, g, unknown or other
  misc_feature (400)..(400): n is a, c, g, or t
tcagcgatcgtatacacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccatattcttatggtaccagcagaagccaggccaggcccctgtgtgtgatatataaagacactgagaggccttcagggatccctgagcgattcctctgctccactcagggacaatggtacactattacgaccatcagtggagtccaggcagaagacgagctgactattcngtacaatcttacagacatcagtgtacttatgtacttcggaacttgggaaccaaagggttccaccgttaccgtacggttacgaacgaccccaaacggacccaaacccctactacgtacctaccg

SEQ ID NO: 322995 - DNA, 530 bp, Homo sapiens
  misc_feature: GZ8MTXP02FQ8N4.51.6.A06.1.454.CMB.2.raw
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgcattcgaccaacccactattcttattggtaccagcagaagccaggccaggcccctgtgttgttgatatataaagacactgagaggcctttcgagggactcccgtgagcgattctctcggctccactcaggacagtcggtacactattcgaccatcgagtggagtaccaggacaagaagacgaggctagacttattcgtagtacaatcttananactatcgagttgtacttatgtctacggaactcgggacaggtccaccgtacgtacgtcacgaccgaacggacccaacccactcgtacacgtcttccccg

SEQ ID NO: 322996 - DNA, 605 bp, Homo sapiens
  misc_feature: GZ8MTXP02HDWAG.51.6.A06.1.454.CMB.2.raw
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
  modified_base (493)..(493): a, c, t, g, unknown or other
  misc_feature (493)..(493): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccaggcctgggaggtccctgagactctcctgtgaagcctntggattcagtcttcagttacgtatggtttgcgtcgtggggtcccncaggcctccgaggcaaggggctggcaggtgggtgctagtctatactcaatagtaggaaaaggaagactaaaattaaaactaccgtaacgactaaggaccgttccggtaggaaacggggaccctaagttaccaacctataccctacccgaagaacgaaaccaaactaccccaaaagaaccactactttanactagaacaaatcgaaacctacctagacgtactggaacggtaccacggtctacgtacttaacgttacttggtacgcggtaaggaggggaactagtacggactacgaacgacg

SEQ ID NO: 322997 - DNA, 541 bp, Homo sapiens
  misc_feature: GZ8MTXP02FTXPW.51.6.A06.1.454.CMB.2.raw
  modified_base (262)..(262): a, c, t, g, unknown or other
  misc_feature (262)..(262): n is a, c, g, or t
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
  modified_base (398)..(398): a, c, t, g, unknown or other
  misc_feature (398)..(398): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtgggtccagccgtggggaggtccctgagactctcctgtgaagccctntggattcagcttcagtacgtatggttgcgcgtgggtccncaggctccaggcaagggctgcaggtgggngcatctatatcatatagaaaggaagcaaataaactactacgcaagactcgtagacggccatcacatcncagagacaactacccaaagaacactacttatctagacaaaatcgaaacctacccgtagacgtaacttaggaacggtaccacgggcttaggtacttaatttacgtgtagacggaaggaggggaacagtcgaataccaacgaacg

SEQ ID NO: 322998 - DNA, 600 bp, Homo sapiens
  misc_feature: GZ8MTXP02JIMRC.51.6.A06.1.454.CMB.2.raw
  modified_base (420)..(420): a, c, t, g, unknown or other
  misc_feature (420)..(420): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaaacccatattcttattggtaccagcagaagccaggccagcccctgtgttgtgatatataaagacactgagaggccttcagggactccctgagcgattctctcggcctccacctcagggacaagtggtcactattcgaccatcagtggagtccaggcagaagacgaggctagacttattctgtctaaatcttanagacatacaggttaggtactttagtcgttacgtttacgggaacgttacggggaaccgtaaagggttcccgaacccggttacccgttacggggttaccctaaccggtaacccccgaaaaccggggaccccctaaaaccccccgtacgtaccggtaccctaacctttcccgtttacccccgg

SEQ ID NO: 322999 - DNA, 623 bp, Homo sapiens
  misc_feature: GZ8MTXP02JDLM2.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaacccattattcttattggtaccagcagaagccaggccaggcccctgtgttgtgatataataaagacactagagaggtccttacgagggactcccgtgagcgtattctcgtcggcctccactcgagggactaagtggtaccactagttacgacctacgtacgaggttgggacgttcccgaagggacgaaggaaacggacgaggtacctaggtaacttagtttcgtagtactaaacgttcttacaagtactatcgtaaggttacggtaactttagtcgttacgttacgggaacgttcgggaaacctacggtaccgtaccgtacgtacggtaccgaacgtaccccgaaacgggaccccaaacccgtactacggtacctaccgttccgtttccccgg

SEQ ID NO: 323000 - DNA, 523 bp, Homo sapiens
  misc_feature: GZ8MTXP02FU2Q2.51.6.A06.1.454.CMB.2.raw
  modified_base (257)..(257): a, c, t, g, unknown or other
  misc_feature (257)..(257): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (352)..(352): a, c, t, g, unknown or other
  misc_feature (352)..(352): n is a, c, g, or t
  modified_base (397)..(397): a, c, t, g, unknown or other
  misc_feature (397)..(397): n is a, c, g, or t
  modified_base (425)..(425): a, c, t, g, unknown or other
  misc_feature (425)..(425): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggaggtccctgagctctcctgtgaagcctntggattcagcttcagtacgtatggtttgcgctggggtccnccaggcctccaggcaagggctgcaggtgggngcatctatatcatatgaaaggaancaaaataaatactacgcaagactccgtagagggccatcaccatcncagacacaatcccaaagacacactttanctagacaaatcgaacaccctaggacactagaacgtacacgggcttagtacttaattacgttagtgacggaagtagggatacgtcgaactcaacgaacg

SEQ ID NO: 323001 - DNA, 605 bp, Homo sapiens
  misc_feature: GZ8MTXP02JPOHN.51.6.A06.1.454.CMB.2.raw
  modified_base (218)..(218): a, c, t, g, unknown or other
  misc_feature (218)..(218): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtcgtccccaggacagacggccaggatcacctgctcgtgganatgcattcgacccaaccctattattcttagttcggtaccagcaagaagccaggccacggccctgtgttgtgatatataaagacactgagacgtccttacgaggtactccgtgacgtcgtattctcgtcggcctccacgttacgagggactaagtcggtacaactattcgaacctataccgaggtcggtacgtaccggaggacgaaaggaaaggtacgagggtacctagtaactttactttccgtagtactaattcgttacagtactatcgtaggttacggttacttagtcgttacgttacggacggttacggaaccgacgtcctaaccggtcgtaacggtccaacgtacccgaacgaccctacccactcgtacccacttcctccccg

SEQ ID NO: 323002 - DNA, 553 bp, Homo sapiens
  misc_feature: GZ8MTXP02H4RUC.51.6.A06.1.454.CMB.2.raw
  modified_base (381)..(381): a, c, t, g, unknown or other
  misc_feature (381)..(381): n is a, c, g, or t
tcagcgatcgtatacacgaccggtgctcgatttagatctactgacagggcacgaccggtgctcgattttagatctactgacagggggctgtgggtccaggaggcagaactctgggtgtctcaccatggcctggatccctctacttctcccctcctcactctctgcacaggctctgaggcctcctatgtgctgacacagcccaccctcggtgtccgtgtcccccaggacagacggccaggatcacctgctctggagatgcattcgaccaacccatattcttattggtaccagcagaagcccaggccacggcccctgtcgttgttgatataataaagaccactgagacggtccttacgagggctcccgtagaacgcgtattcncttggcctccgactcgaggaccaagtggtacacattacgacatcaagtggatccgaggcagaagacgaggtctagaccttattctgttacaattccttaacacgtactacgtacgtaagttacgttaacttagttacgttacgttacggtaacgttacgggaaaccgtacgg

SEQ ID NO: 323003 - DNA, 646 bp, Homo sapiens
  misc_feature: GZ8MTXP02HK41E.51.6.A06.1.454.CMB.2.raw
  modified_base (324)..(324): a, c, t, g, unknown or other
  misc_feature (324)..(324): n is a, c, g, or t
  modified_base (390)..(390): a, c, t, g, unknown or other
  misc_feature (390)..(390): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcagggtgcagctggtgcaggtcgtgggggagcgtggtccaggccgtggggacggtccctggacgtacctctccgtggtgaacgtccctcgtggattccagtcttacgaggtacgtagttggtttcgcgcgtgggtccccncgaggcctccgaggccgaagggctgcgaggtgggtgcagtctaagtatcataagtggaaaaggaanactaaaattaaaactcgtaccgactaagacccgttcccggtaggaaacgggacccgtattaccgacctacgtcctaccgaagaacgaaccaactaacccgaaaagaacctaactaacttttacacgtacgaaacaaatacgaaaaccctacccgtagtaacgtaaccgttaggaacggtacctaacgggtctaggttacttaacgtttagtcggtagacggaaggtaacggggatacgacgtaacacgaacgacgg

SEQ ID NO: 323004 - DNA, 492 bp, Homo sapiens
  misc_feature: GZ8MTXP02JX7OO.51.6.A06.1.454.CMB.2.raw
  modified_base (477)..(477): a, c, t, g, unknown or other
  misc_feature (477)..(477): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccactcagggacaatggtcacattgaccatcagtgagtccaggcagaagacgaggctgactattctgtcaatcttcagacatcagtggtacttatgtctcgaactgggacaggtcaccgtctagtcacgcccaaggcccaacccnctcgtcactcttccg

SEQ ID NO: 323005 - DNA, 708 bp, Homo sapiens
  misc_feature: GZ8MTXP02F5UO0.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgtgatatataaagacactgagaggtccttcgagggactccctgagcgattctctcggcctccacctcgaagggaccaagttcgggtccaacgtatttacgaaccctagtacgagtgggaacgttcccgaagggacaaaggaaaggaccggagggtaccttaggtaaacctttatttaccgttaggttacctaaaatttcccgtttactaaacggaaccttaacttaccggtaaaggtttacgggtttaaccttttaagtttacggttaccgtttaccggggaaacgtttaccgggggaaacccgtaaagggggttacccctaacccgggtttacccgttaacgggtacccgaaccggacccccgtaaaacgggtacccccaaaaccccccggtacttaccggtaccctaacccgtttaccgttttcccccgg

SEQ ID NO: 323006 - DNA, 507 bp, Homo sapiens
  misc_feature: GZ8MTXP02GF6IL.51.6.A06.1.454.CMB.2.raw
  modified_base (293)..(293): a, c, t, g, unknown or other
  misc_feature (293)..(293): n is a, c, g, or t
  modified_base (421)..(421): a, c, t, g, unknown or other
  misc_feature (421)..(421): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagctctggattcagcttcagtacgtatggttgcgctgggtccnccaggctccgaggcaagggctgcaggtgggtgcatctatatcatatgaagaagcaaataaatactacgcaagactccgtagaaggccattcacatctccagacgacaatcccaaagacactactttanctagacaaatgaacaccctagagtactgaggacacgggctaggtactattacgtgtgacgaagagggtacatccgataccgacacg

SEQ ID NO: 323007 - DNA, 611 bp, Homo sapiens
  misc_feature: GZ8MTXP02IEXCF.51.6.A06.1.454.CMB.2.raw
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctctatgtgctgacacagccaccctggtgtccgtgtccccaggacagacggccaggatcacctgctctggagatgctattcgacccaaccctattatttcttattcggtaccagcagagccaggcaggccctgtgttgtgatatataaagacactgagaggtccttagagggctcccgtgagcgtattctctcggcctccacctcgaagggaccaagtcggtacaacgtactttacgaccctataccgtaggtagtacgacccgaagggccaaaggaaacggacggaacgggtctacggtaacctttaagtttctacggttactaaattcctttaacgacgtatacgtacgtagtttacgttacgttacgttacgttacgtacgtaacggtacggaacgtacgtaccgtaccgtcgtacgtccgaaccgacccgaaccgaccccacctactactacctacttacctccg

SEQ ID NO: 323008 - DNA, 694 bp, Homo sapiens
  misc_feature: GZ8MTXP02JP4YI.51.6.A06.1.454.CMB.2.raw
  modified_base (307)..(307): a, c, t, g, unknown or other
  misc_feature (307)..(307): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccaggccgtggggacggtccctgagactctcctgtgaacgcctgtggattcagtcttcagtacgtatggtttgcgcgtggggtcccncgaggcctccgaggcgaagggctggcaggtggggtgcatctatatctaatagtaggaaaaggaacgactaaaattaaaacgtaccgtaaccggactaaggtaacccgttcccgggtaagggaaaccgggggaccctaacgtttacccaacctacgtacctacccgaaaggtaaccgaaaccaaacctaaccccgaaaagtaaaccctaacttaaccttttactaccgttacggaaacctaaaattaccggaaaaccctaccccgttaggaacgttaaccgtagggaaacggtaaccgaccgggttacttacggttaacttagtttaacgttcggtacggacgggtaagggaaggggtaagtaacgttacggaactcgaaacgaccgg

SEQ ID NO: 323009 - DNA, 522 bp, Homo sapiens
  misc_feature: GZ8MTXP02FZPCE.51.6.A06.1.454.CMB.2.raw
  modified_base (295)..(295): a, c, t, g, unknown or other
  misc_feature (295)..(295): n is a, c, g, or t
  modified_base (350)..(350): a, c, t, g, unknown or other
  misc_feature (350)..(350): n is a, c, g, or t
  modified_base (431)..(431): a, c, t, g, unknown or other
  misc_feature (431)..(431): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggttgcgctgggtcccncgaggctccgaggcaagggctgcaggtgggtgcatctatatcatatggaaaggancaaataaatacacgcaagactccgtagaacgggccattcacatctaccaagacgacaactcccaaagaaccactactttanctagacaaatcgaaacaccctagagtacgttgaacggacacggctagtacttattacgttgtgacgaaggaggagacgtcgaatcaacacg

SEQ ID NO: 323010 - DNA, 587 bp, Homo sapiens
  misc_feature: GZ8MTXP02ITPHC.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgacccaacccactattcttattggtaccagcagaagccaggccaggcccctgtgttgtgatatataaagacactgagaggccttcgagggtactccctgagcgattctctcggcctccacctcacgggacaagtggtcactattcgaccatcagtgagtccagcagaagacgaggctgacttattctagtactaacttcttacagtacataccgtagttacggttactttaacgttgttacgttacggtaaaccgttcggggaacccttaaagggtcccgtaaacccgttaccgtacgggtaccaccggaccccgaaacggacccccaaaccccacgttcgtaccctaccgttccctttcccccg

SEQ ID NO: 323011 - DNA, 576 bp, Homo sapiens
  misc_feature: GZ8MTXP02F4A54.51.6.A06.1.454.CMB.2.raw
  modified_base (394)..(394): a, c, t, g, unknown or other
  misc_feature (394)..(394): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaaccactattcttattcggtaccagcagaagccaggccaggccctgtgttgtgatatataaagacactgagaggccttcgagggtactcccgtgagcgtattctctcggctccactcaggacaatggtacactattcgaccatacagtgagtccaggacagaagacgngctagactagttctagtacaattcttacagaactatcgagttggttaacttagtgttcgttacggaacgttacgggactaacgggtcctaaaccggttccgtaacgggtacccaaccggaccccgaaaccggtaccccaaaccccgtaccgttacgtaccctaaccgttcgtttacccccgg

SEQ ID NO: 323012 - DNA, 596 bp, Homo sapiens
  misc_feature: GZ8MTXP02G6MXC.51.6.A06.1.454.CMB.2.raw
  modified_base (227)..(227): a, c, t, g, unknown or other
  misc_feature (227)..(227): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (261)..(262): a, c, t, g, unknown or other
  misc_feature (261)..(262): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggtttcgcgtaggctctttaagaggtgtccagtgtcaggtgcagctggtgcagtctgggggaggcgtggtccagcctgggnggtcctgagactctcctgtgagccctntggtntnnctctagtagtagtggttgtcgtcgtcggtccgcgacgcgtcgacggacgaacggacgtgcgtaggtgggtggtcgtactacgtactatactagtagtaggtaaaggaagactaaataaactaacgtaacgtacgtaacgtacgtacggtacggtaacggtaccgtacgtacacctacgtactaccacgaacgaacaactaaccaaacgaaactaactacttactactacgtaactaaacgtaacgaactacgtacgtagtacgtagacgacgacgtcgtacgtagtacttacgtacgtagtagaaggaggacgtacgtacgtactacgacgacg

SEQ ID NO: 323013 - DNA, 607 bp, Homo sapiens
  misc_feature: GZ8MTXP02I39PY.51.6.A06.1.454.CMB.2.raw
  modified_base (302)..(302): a, c, t, g, unknown or other
  misc_feature (302)..(302): n is a, c, g, or t
  modified_base (374)..(374): a, c, t, g, unknown or other
  misc_feature (374)..(374): n is a, c, g, or t
  modified_base (469)..(469): a, c, t, g, unknown or other
  misc_feature (469)..(469): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagactctcctgtagagcctcgtggattcagtcttcagtacgtagtggttgcgtcgtggggtcccnccgaggcctaccgaggcaaaggggctggctagggtggggtgcaagtctaatatcaatagtaggaaaaggaanactaaaataaactaccgtaacgataacgtaccgtaccggtaagaacggacctaactaccaactactaccaccgaagaacaacaaacaaccaaaanaacctaactaacttagactacaaactaaaagtacgaaacctaccgtagaacgtacgtaggaacgtacgtacggtactacgttacttagttacgtacgtagacgaaggacggtaacgtacgtacgacgtacgaacgacg

SEQ ID NO: 323014 - DNA, 575 bp, Homo sapiens
  misc_feature: GZ8MTXP02JQP3O.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccatattcttatggtaccagcagaagccaggccaggcccctgtgttgttgatatataaagacactgagaggccttcgagggatccctgagcgattctctcggcctccacctcgagggacaatggtcactattgaccatcagtgagtccaggcagaagacgtagctgactatttctagtctaaatcttacagactatcagtggttacttagtgttacttacggaacttcggggaacctaaacggggtccaacccggttaccgttaacgggtccgtaaccggaccccgtaaacgggccccctaaaacccccgcgttaccggttaccctaacccgttaccgtttcccccgg

SEQ ID NO: 323015 - DNA, 606 bp, Homo sapiens
  misc_feature: GZ8MTXP02IIRQA.51.6.A06.1.454.CMB.2.raw
  modified_base (218)..(218): a, c, t, g, unknown or other
  misc_feature (218)..(218): n is a, c, g, or t
  modified_base (397)..(397): a, c, t, g, unknown or other
  misc_feature (397)..(397): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgctattcgacccaaaccacttattccttattaggtaacaagcagaacgccaggccacggccctgtcgttgtgatataataaagacactagagacggtcctttacgagggtactcccgtgagcgtatttcccgcgtggcctccactcgagggacaagtggtaccaactattcgaactntcgagtggaacgtccgaggacaagaacggacgaggtactagtaacttatttacgtgtaactaacttcttacacgtaacacttacgaagttggttaactttagtcgttacgttacggtaacgttcggggaaacctacgggtacctaccgtaccgtaggtaccgaacgtaccccgaacggacccctaacccgtactaccgttcctaacccg

SEQ ID NO: 323016 - DNA, 521 bp, Homo sapiens
  misc_feature: GZ8MTXP02HTG91.51.6.A06.1.454.CMB.2.raw
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
  modified_base (402)..(402): a, c, t, g, unknown or other
  misc_feature (402)..(402): n is a, c, g, or t
  modified_base (510)..(510): a, c, t, g, unknown or other
  misc_feature (510)..(510): n is a, c, g, or t
  modified_base (519)..(519): a, c, t, g, unknown or other
  misc_feature (519)..(519): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggaggtccctgagactctcctgtgaagccctctggattcagtcttcagtacgtatggtttgcgcgtgggtcccgccaggctccgaggcaagggctgcaggtgggtgcagtctatatcatatgaaggaagcaaataaanactacgcagactccgngaaggcatcacatcacaganaacatacccaaagaaccactaactttatactagacaaatacgaaacaccctgaacgtactagaacggacacggtctattctattacgtcgtagacgaagagggactanacgacacancg

SEQ ID NO: 323017 - DNA, 517 bp, Homo sapiens
  misc_feature: GZ8MTXP02ICWDF.51.6.A06.1.454.CMB.2.raw
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagaggccttcgagggatccctgagcgtattctctcgcctccacctcgagggaccaatggtacacattagaccatacagtgagtccaggcagaaagacgagctagacttattcngtcaatcttanagtacatcagtgtacttatgtctcgaacgttcggaacctaggtcctaccggtcctaggtcacgaccgaacggcccaaacccactcgtccactctcccg

SEQ ID NO: 323018 - DNA, 553 bp, Homo sapiens
  misc_feature: GZ8MTXP02IHLTF.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaccacttattcttattcggtaccagcagaagccaggccaggcccctgtgttgtgatatataaagacactgagaggcctttcgagggatccctgagcgtattctctcggctccactcgagggacaagtggtcactagttcgaccatcgagtgggatccgaggcaagaagacgaggctagtactatttcgtagtcaaattcttacagactatacgtagttggttaacttagttgttacgttacggacgttacgggaaccgtaaggtccaccgtctacggtacacgaccctaacggacccaaccccatcgtcctaacctcttacccg

SEQ ID NO: 323019 - DNA, 590 bp, Homo sapiens
  misc_feature: GZ8MTXP02JVX35.51.6.A06.1.454.CMB.2.raw
  modified_base (411)..(411): a, c, t, g, unknown or other
  misc_feature (411)..(411): n is a, c, g, or t
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagcccaccctcggtgtccgtgtccccaggacagacgccaggatcacctgctctggagatgctattcgacccaaaccctattatttcttagttggtacccagcaagaacgccaggccacggcccctgtgttgttgatataataaagacactgagaggccttagagggtactccctgagcgtattctctcggcctccactcgagggacatggtcactattcgaccatcgagtgacgtccgaggcaggaagaggngctgacttattctgtacaacttcttacagtactatacgaggttaggttaacttagttgttacgttacggaaacggttcgggaaaccctaagggtcccgtaaacccgtccgttacggtaccacggaacccaaccgggacccctaaacccgacgttcctacctacccttcgtttcccccgg

SEQ ID NO: 323020 - DNA, 561 bp, Homo sapiens
  misc_feature: GZ8MTXP02GQ28R.51.6.A06.1.454.CMB.2.raw
  modified_base (408)..(408): a, c, t, g, unknown or other
  misc_feature (408)..(408): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttaattggtaccagcagaagccaggccaggcccctgtgttgttgatatataaagacactgagaggccttcgagggactccctagacgcgtatctctcggtcctccacctcgagggaccaagtggtcactattgaccatcagtgagtccgagacagaagacgagctagacttnttctgtacaaatcttacagtacacgtactagttaggttaactttatcgttacgttacgggaactgggaacccgtaagtcccgtaccgtcgttacgtacacgtacccgaacggtaccccaaaccccgtacgtacgtccaacttccgttccccgg

SEQ ID NO: 323021 - DNA, 548 bp, Homo sapiens
  misc_feature: GZ8MTXP02GPTV6.51.6.A06.1.454.CMB.2.raw
  modified_base (434)..(434): a, c, t, g, unknown or other
  misc_feature (434)..(434): n is a, c, g, or t
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagcccaccctcggtgtccgtgtccccaggacagacggccaggatcacctgctctggagatgcattcgacccaacccacttattcttattggtaccagcagagccaggccaggccctgtgttgtgatatataaagacactgagagccttgaggactcccgtgagcgtattctctcggctccactcgaggacaagtggtacactattacgacctatcgaggtagacgtccaggacaaggaaagacgaggctagacttattctagtacattcttaganacatcgagttagtattagtgtcgtacgaacgtcgggaacctagggtcaccggtacgtacgtaccacgacccgaacggaccccaaaccccgagtccgtactaccgtccttacccg

SEQ ID NO: 323022 - DNA, 508 bp, Homo sapiens
  misc_feature: GZ8MTXP02GBE2G.51.6.A06.1.454.CMB.2.raw
  modified_base (350)..(350): a, c, t, g, unknown or other
  misc_feature (350)..(350): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttatggtaccagcagaagccaggccaggcccctgtgttgttgatatataaagaccactgagaggccttcgagggntccctgagcgattctctgctccacctcgagggacaagtggtcactattgaccatcagtggagtccaggcagaaagacgaggctagactattctgtactaatcttcagacatcgagttggtaacttagtacgttcttaggaactcggggaacctaaagg

SEQ ID NO: 323023 - DNA, 536 bp, Homo sapiens
  misc_feature: GZ8MTXP02IBSLZ.51.6.A06.1.454.CMB.2.raw
  modified_base (190)..(190): a, c, t, g, unknown or other
  misc_feature (190)..(190): n is a, c, g, or t
  modified_base (294)..(294): a, c, t, g, unknown or other
  misc_feature (294)..(294): n is a, c, g, or t
  modified_base (400)..(400): a, c, t, g, unknown or other
  misc_feature (400)..(400): n is a, c, g, or t
  modified_base (423)..(423): a, c, t, g, unknown or other
  misc_feature (423)..(423): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcagggtncagctggtgcagtcgtgggggagcgtggtccagcctgggagtccccgagctctctgtgagcctctggattcagcttcagtacgtatggttgcgtcgtgggtccnccaggcctccgaggcaagggctgcaggtgggtgcatctatatcatatagaaggaagcaataaatactacgacagactcgtagaacgggccattcacatctacaganacaatcccaagacactactttanctagacaaatcgaaaccaccctgaacgtacttaggaacgtaccacgggcttaggtcttaattagttcgagtcggaaggtaaggggacaacgttcgaagtcaacgtaggacccg

SEQ ID NO: 323024 - DNA, 512 bp, Homo sapiens
  misc_feature: GZ8MTXP02HUIH8.51.6.A06.1.454.CMB.2.raw
  modified_base (312)..(312): a, c, t, g, unknown or other
  misc_feature (312)..(312): n is a, c, g, or t
  modified_base (423)..(423): a, c, t, g, unknown or other
  misc_feature (423)..(423): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccattattcttattggtaccagcagaagccaggccaggcccctgtgttgttgatatataaagacactgagaggccttcagggntccctgagcgattctctcggctccacctcagggaccaatggtcactattcgaaccatcagtgagtcccgaggcagaagacgaggctagactatttctagtctaattcttanagacatcagtgtactatgtcttgactggacaggtcacgtaccgtagtcacgcccgaacggcccaacccgactcgtaccactacttcccg

SEQ ID NO: 323025 - DNA, 640 bp, Homo sapiens
  misc_feature: GZ8MTXP02ITP2U.51.6.A06.1.454.CMB.2.raw
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccatattcttattggtaccagcagagccaggccaggcccctgtgttgttgatatataaagacactgagacggcctttcgagggactccccgtgacgcgtactttcctcgtcggcctacccaccgttccgaaggggacctaaagttcgggtaccaacgtatttacgaccctataccgaggttaggacgtccgaggacaagaaggacggaggctaggacttagtttccgtgttactaattccttacaagtaacctagttaccgtaggttacggttactttaagttcgttaccgtttacgggaaaccgttcggggtaaaccctaaaggggttccctacccggttaccgtacgggttaccgaacgacccccgaaacggaccccaaaacccccgtacttccgtacttaacccg

SEQ ID NO: 323026 - DNA, 591 bp, Homo sapiens
  misc_feature: GZ8MTXP02IK5WI.51.6.A06.1.454.CMB.2.raw
  modified_base (299)..(299): a, c, t, g, unknown or other
  misc_feature (299)..(299): n is a, c, g, or t
  modified_base (359)..(359): a, c, t, g, unknown or other
  misc_feature (359)..(359): n is a, c, g, or t
  modified_base (451)..(451): a, c, t, g, unknown or other
  misc_feature (451)..(451): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgaacgcctctggattcagtcttcagtacgtattggttgcgtcgtgggtccnccgaggcctccgaggcaagggctgcgaggtgggtgcagtctatatcatagtagaaagganctaaataaatactacgcagactccggagaacggcctatccactatcctaccaagacgaaccaaactacccaaaagaacctaactaactttanacctagaacctaaatacgaaacctacccgtagacgtaacgtaggaacgaaccgtacggtacttacgttacttaaacgtttagttacggtacgacgggtaaaggacggggtaagtaacgtacgacgtaccgaacgtaccgg

SEQ ID NO: 323027 - DNA, 557 bp, Homo sapiens
  misc_feature: GZ8MTXP02GIQT5.51.6.A06.1.454.CMB.2.raw
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
  modified_base (442)..(442): a, c, t, g, unknown or other
  misc_feature (442)..(442): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggagtccctgagactctcctgtgagcctntggattcagcttcagtacgtatggttgcgtcgtgggtcccncgaggcctccgaggcaaggggctggcaggtgggtgcagtctatatcatatggaaaggagcaaaataaatacgtacgcaagacctcgtagaacgggccgattcaccatccaccagacgacaactacccaaagaaccactactttanactagacaaatcgaaccacctagagtacgttagaacggactacggcttacgttacttaagtttacgttcggtaggtacggaaggacggggaagtacgtaccgataccgaacgacg

SEQ ID NO: 323028 - DNA, 623 bp, Homo sapiens
  misc_feature: GZ8MTXP02I3CH7.51.6.A06.1.454.CMB.2.raw
  modified_base (156)..(156): a, c, t, g, unknown or other
  misc_feature (156)..(156): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (299)..(299): a, c, t, g, unknown or other
  misc_feature (299)..(299): n is a, c, g, or t
  modified_base (499)..(499): a, c, t, g, unknown or other
  misc_feature (499)..(499): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttccncgttgctcttttaagaggtgtccagtgtcaggtgcagctggtgcagtcgtgggggagcgtggtccagccgtgggagtccctgagctctctgngagcctntggattcagtcttacagtacgtatggttgccgtcgtgggtcccncgaggcctaccgaggcaaggggactgcgagggtgggtgaccagtctaatacgtcaagtagtaggaaaggtaagcctaaaattaaactacgtaccgactaacgtaccgtccggtagggaacgggtaccgtaacttaccaaccgtacttaccgtacccgaagaacgtaaccaactacccaaaagtaacctactaacttttanacgtagaactaaaacgtacgaaaccctcccgtaggtaccgtacgttacgggacggtaaacgcggtaccgttggtacttagtttacgtgtcgaggaaggagggatactacgtactacgaacgacg

SEQ ID NO: 323029 - DNA, 593 bp, Homo sapiens
  misc_feature: GZ8MTXP02FZWN2.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgctattcgacccaaacccacttattcttattcggtaccagcagaagccaggccaggcccctgtgttgtgatatataaagacactgagaggccttcgagggactccctggacgcgtattctctcggctccactcgaggacaagtggtacactattcgacctatacaggttgggacgtacccgaaggccaaaggaaacgacggacggtctaggtaacttagtttctagtactaaattccttacagtactaatccgaagttggtaactttagtcgttacgtttacggaaacgttacggggaacctaaaggtccaaaccggttcgtacgtacacgaccccaaacggccccaaaccctacgtctaccacttccgttacccg

SEQ ID NO: 323030 - DNA, 659 bp, Homo sapiens
  misc_feature: GZ8MTXP02GAIXH.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagtatgctattcgacccaacctacttattcttagttcggtacagcaagacgccgacgccgacggccctgttgttgtagataataataaagactacgtagaaggtacgtccgttacggaaggtacctcccgtaggacgtacgtacttccgtcgtccggtccctacccacctacggaacggaactaagttcgaccaacttagttaccgaacctagtaccgtaggtacgacgtacccgaaggacaaaggaaacgaacggacgtactaacgtaacttacttcgttacgtactaaacttctttaccgaagtaactaatacgtaggttacgtttaacttagttcgttacgttacggaacgtacgggaaccgtaaacggtcctaaccgtacgttacggtaccgaccgaacccgaaacggccccaaacccgtactcgtaccacctctttcccg

SEQ ID NO: 323031 - DNA, 562 bp, Homo sapiens
  misc_feature: GZ8MTXP02F2GF3.51.6.A06.1.454.CMB.2.raw
  modified_base (189)..(189): a, c, t, g, unknown or other
  misc_feature (189)..(189): n is a, c, g, or t
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
  modified_base (332)..(332): a, c, t, g, unknown or other
  misc_feature (332)..(332): n is a, c, g, or t
  modified_base (359)..(359): a, c, t, g, unknown or other
  misc_feature (359)..(359): n is a, c, g, or t
  modified_base (409)..(409): a, c, t, g, unknown or other
  misc_feature (409)..(409): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcagtcgtgggggagcgtggtccagcctgggagtcctgagactctctgtgaagcctntggattcagcttcagtacgtatggtttgcgtcgtggggtccnccgaggcctccgaggcaaaggggctgcaggtcgggngcagtctatatcaatatggaaaagganacaaataaaatactacgcaagacctcgtagaacggacccatcacctatcnccaagacgacaaactacccaaaagaaacctaactaactttatacctagaacaaaaacgtcgaaaacctaccccgtaagaacgtaacgttaggaacggaacacggtctagtacttaattatcgtgacgaaggaggatacgtacgatcaacgacg

SEQ ID NO: 323032 - DNA, 583 bp, Homo sapiens
  misc_feature: GZ8MTXP02FICQJ.51.6.A06.1.454.CMB.2.raw
  modified_base (215)..(215): a, c, t, g, unknown or other
  misc_feature (215)..(215): n is a, c, g, or t
  modified_base (258)..(258): a, c, t, g, unknown or other
  misc_feature (258)..(258): n is a, c, g, or t
  modified_base (319)..(319): a, c, t, g, unknown or other
  misc_feature (319)..(319): n is a, c, g, or t
tcagcgatcgtatacacgaccggtgctcgatttagatctactgacagggtctgggagacgagcccagcactggaagtcgccggtgtttccattcggtgatcatcactgaacacagaggactcaccatggagtttgggctgagcgtggtttcgcgtaggctctttaagaggtgtcagtgtcaggtgcagctgtgcagtgtgggaggcgtggtccgngcgtggtcggtcgtgagactctcgtgtagacgctcgtgtgtcncgtctcgtagtacgtagtgttgtcgtcgtcggtccgcgcgcgtacgacggacgacggacgngcgaggtggtgacgtagtactactatacgtagtagtaggaggaagtactaaacgtaaactacgtacgacgacgtacgtacgtacgacggtacgtacgtactactactacgtacgacgacgacaacacaacgaacactactactacgtacgaactaacgtacgactacgtacgacgtacgtacgacgacgtacgtacgtacgtacgttacgttacgttacgtacgtacgtaaggtacggtacgtacgtacgtacgtacgacgacg

SEQ ID NO: 323033 - DNA, 539 bp, Homo sapiens
  misc_feature: GZ8MTXP02HPV21.51.6.A06.1.454.CMB.2.raw
  modified_base (428)..(428): a, c, t, g, unknown or other
  misc_feature (428)..(428): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggaggtccctgagactctcctgtgaacgcctctggattcagcttcagtacgtatggtttgcgctgggtccgccaggctccgaggcaagggactgcaggtgggtgcatctatatcatatgaaggaagcaaataaatactacgcaagactccgtagaaggccgatcgacatctccagacgacacaccaaagaaacacactttanctagacaaatacgaaacaccctagaacgtacttagaacggtacacgggtctagtacttaaatttcgttacggttagcggaaggagggagtacgtacggactacgacaacgg

SEQ ID NO: 323034 - DNA, 576 bp, Homo sapiens
  misc_feature: GZ8MTXP02ICRBC.51.6.A06.1.454.CMB.2.raw
tcagcgatcgtatacacgaccggtgctcgatttagatctactgacagggcacgaccggtgctcgattttagatctactgacagggggctgtgggtccaggaggcagaactctgggtgtctcaccatggcctggatccctctacttctccccctctcactctctgcacaggctctgaggcctcctatgtgctgacacagcccaccctggtcgtccgtcgtccccaggacagacggccaggatccactgctctggagatgctatcgacccaacctactattcttatcggtaccagcagagccaggccacggccctgtgttgtgatatataagcactgagacgtccttagacgggtctcccgtagacgtcgtattctcgtcgtcctccgacctcgaagggaccaaagtcggtacaactagttacgaaccctatacgtaaggttcgggacgttacccgaagggaccgaaagggaacggtacggaggtctaggtaccttagtttcagttaccaattcgttacaagactatacgtagttcgtaacttagtcgttacgtacggtacgtacggaaccctaacgg

SEQ ID NO: 323035 - DNA, 492 bp, Homo sapiens
  misc_feature: GZ8MTXP02IOG7A.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttatggtaccagcagaagccaggccaggccccctgtgttgttgatatataaagaccactgagagccttcagggctccctgagcgattctctggcctccacctcagggacaagtggtcacatgaccatcagtggagtccaggcagaagacgaggctgactattctgtcaattctacagacatcagtgtaactatgtcttacggactacggactaacgg

SEQ ID NO: 323036 - DNA, 709 bp, Homo sapiens
  misc_feature: GZ8MTXP02JRHEI.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgccaaaccctactattcttattggtaccagcagaagccaggccagccctgtgttgtgatatataaagacactgagagcttcagggactcctgagcgtatctcgtcgcctaccacctcgacgggactaagtcggtaccaactatttacgaccctattaccgagggttcggaacgttcccgaagggccaaaggaacgaacggacggcgttacggaacctttagttttctcggttaacctaaatttcccgttaacacggtaaccgtaattaccgtaaggttacgggtttaactttaaggttcggtttacccgtttaacgggaaaccggtttacgggggtaaacccgtaaacgggggttaccccgtaaacccggtttaccccggtaaacgggttcccgtaaaaccggacccccgtaaaaccggggaacccccccaaaaccccccggttaaaccttccggttaccctaaccctttcccggtttaacccccg

SEQ ID NO: 323037 - DNA, 606 bp, Homo sapiens
  misc_feature: GZ8MTXP02HF17L.51.6.A06.1.454.CMB.2.raw
  modified_base (491)..(491): a, c, t, g, unknown or other
  misc_feature (491)..(491): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggacggtccctgacgactctctgtgacgcctctggattcagcttcagtacgtattggttgcgtcgtgggtcccgccgaggcctccgaggcgaaagggctggcgaggtgggtcgctagtctagtatcaattagtaggaaaaggaacgactaaaattaaaactaaccgtacgactaacgacctccgggtaaggaaacgggtcccgtaattcccgaacctacgtcctacccgaagacgaacaactaccaaagaacaactactttanactagaactaaatacgaacctacctgaacgtacgtaggacggacgtacggtctacgtacttagttacgttggtacgacggaaggtagggagtacgtacgactaccgaacgaccgg

SEQ ID NO: 323038 - DNA, 646 bp, Homo sapiens
  misc_feature: GZ8MTXP02IOW2E.51.6.A06.1.454.CMB.2.raw
  modified_base (300)..(300): a, c, t, g, unknown or other
  misc_feature (300)..(300): n is a, c, g, or t
  modified_base (334)..(334): a, c, t, g, unknown or other
  misc_feature (334)..(334): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggaggtccctgagactctcctgtgaagcctctggattcagtcttcagtacgtatggttgcgtcgtgggtcccncgaggcctcgaggcgaagggctgcgtaggtgggngctatctatagtcaagtataggaaaaggtaagctaaaattaaaactaaccgtaccgaacgtaaacgaccgttcccggtaaggaacggggccctaagttcccaacctacttaccctaccgaaaggaacgtaaaccaactaacccccaaaagtaaacccaaccttaacttttactaccgtagaactaaaacgtacgaaaccctacccgtagacgtaacgttaggaacgtaccgaacggtcttacgttacttaaagtttcgttggtacggacggaagggaaggggtaactacgtacgtaacgtaccaacgaacgg

SEQ ID NO: 323039 - DNA, 519 bp, Homo sapiens
  misc_feature: GZ8MTXP02IYTE5.51.6.A06.1.454.CMB.2.raw
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (435)..(435): a, c, t, g, unknown or other
  misc_feature (435)..(435): n is a, c, g, or t
  modified_base (506)..(506): a, c, t, g, unknown or other
  misc_feature (506)..(506): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagttacgtatggtttgcgtctgggtcccgcaggctccgaggcaagggctgcaggtgggtgcagtctatatcatangaaggaancaaataaatactacgcaagactccgtagaagggccgtattcaccatcctaccagaagacaactcccaaagacactactttancctagacaaatcgaaacaccgtgacgtactagacggtacacggctagtctattagtgtgacgaagaggganatcgatcacgacg

SEQ ID NO: 323040 - DNA, 514 bp, Homo sapiens
  misc_feature: GZ8MTXP02I792F.51.6.A06.1.454.CMB.2.raw
  modified_base (292)..(292): a, c, t, g, unknown or other
  misc_feature (292)..(292): n is a, c, g, or t
  modified_base (346)..(346): a, c, t, g, unknown or other
  misc_feature (346)..(346): n is a, c, g, or t
  modified_base (388)..(388): a, c, t, g, unknown or other
  misc_feature (388)..(388): n is a, c, g, or t
  modified_base (423)..(423): a, c, t, g, unknown or other
  misc_feature (423)..(423): n is a, c, g, or t
  modified_base (442)..(442): a, c, t, g, unknown or other
  misc_feature (442)..(442): n is a, c, g, or t
  modified_base (498)..(498): a, c, t, g, unknown or other
  misc_feature (498)..(498): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgagcctctggattcagcttcagtacgtatggttgcgctgggtccncaggctccgaggcaagggctgcgaggtgggtgcatctatatcatatgaaaggancaaataaatctacgcagactccgtagaacggccatcacatcnccagacgacaatcccaaagaacctactaactttanctagaacaaatcgaaaccnccctagacgtactagaaggacacggtctgtacttattagtgtgacggaagaggganacgtgactacgacacg

SEQ ID NO: 323041 - DNA, 487 bp, Homo sapiens
  misc_feature: GZ8MTXP02IOBA2.51.6.A06.1.454.CMB.2.raw
  modified_base (321)..(321): a, c, t, g, unknown or other
  misc_feature (321)..(321): n is a, c, g, or t
  modified_base (363)..(363): a, c, t, g, unknown or other
  misc_feature (363)..(363): n is a, c, g, or t
  modified_base (391)..(391): a, c, t, g, unknown or other
  misc_feature (391)..(391): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactaattcttattggtaccagcagaagccaggcaggcccctgtgttgtgatanataaagacactgagaggccttcagggatccctgagcgattcnctgctcacctcaggcaatggtcacattnaccaatcagtgagtccaggacagaagacgagntgactattcntcatactctanacatactagtgtaagtatacgtcgtacgtacgtacgacgtacg

SEQ ID NO: 323042 - DNA, 562 bp, Homo sapiens
  misc_feature: GZ8MTXP02F6AND.51.6.A06.1.454.CMB.2.raw
  modified_base (397)..(397): a, c, t, g, unknown or other
  misc_feature (397)..(397): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccatattcttattggtaccagcagaagccaggccaggcccctgtgttgttgatatataaagacactgagaggccttcgagggatccctgagcgattctctggctccactcaggaccaatgtcacattgacctatcagtgagtccaggcagagacgaggctgactatttcngtacaaatcttcagacatcagtaggtacttaattgtcttacggtaacgtacgggtaccgtaaacggtacgtaccgttaccgtacggttaccgacgaaccccgaaaccgggaaccccgaaacccccgtaacccgtaccgtttaccgaaccctacctttacccccgg

SEQ ID NO: 323043 - DNA, 558 bp, Homo sapiens
  misc_feature: GZ8MTXP02H68L8.51.6.A06.1.454.CMB.2.raw
  modified_base (330)..(330): a, c, t, g, unknown or other
  misc_feature (330)..(330): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggatcacctgctctggagatgcattgccaacccactatttcttattggtaccagcagaagccaggccaggcccctgtgttgttgatatataaagacactgagaggccttcgaggatccctgagcgtattctntcggcctccacctcgagggacaatggtacactattcgacatcagtggagtccaggcagaagacgaggctgacttattctgtactaaattcgttcaagactatcagttgttacttagttgttcgttacgggtaaactcggggaacctaaacgggtcaaccggttacctacggtaccacggacccaaacggccccaaaaccccgacgttcgtaccctacttccgttcccg

SEQ ID NO: 323044 - DNA, 512 bp, Homo sapiens
  misc_feature: GZ8MTXP02HWGSY.51.6.A06.1.454.CMB.2.raw
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (500)..(500): a, c, t, g, unknown or other
  misc_feature (500)..(500): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcgagggatcccgtgagcgattctctcggctccacctcgagggacaagtcggtcaacattgaaccatcagtgagtccaggcagaagacgagctagacttattcngtcaatcttnagactatcagtgtacttagtgtcttacggaacttcgggacccaaggtccacgtctaggtccacgcccaaggcccaacccacnctcactctcccg

SEQ ID NO: 323045 - DNA, 549 bp, Homo sapiens
  misc_feature: GZ8MTXP02F1CK8.51.6.A06.1.454.CMB.2.raw
  modified_base (154)..(154): a, c, t, g, unknown or other
  misc_feature (154)..(154): n is a, c, g, or t
  modified_base (255)..(255): a, c, t, g, unknown or other
  misc_feature (255)..(255): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
  modified_base (496)..(496): a, c, t, g, unknown or other
  misc_feature (496)..(496): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttcncgttgctcttttaagaggtgtccagtgtcaggtgcagctggtgcagtcgtgggggagcgtggtccaggccgtgggaggtccctgagctctctgtgagcctntggattcagtcttcagtacgtatggtttgcgtcgtcgggtccgccgaggcctccgaggccgaaaggggctgcgaggtgggtgctagtctatatcaatagtaggaaaggaatcaaaataaatactacgctaaggacctcgtagaacgggccattccacatccacaagacgaacaactacccaaagaaccaactactttagctanaacaanacgaacacgtagactacgtagacgacgacgtntacgtacttattacgtgacgaggaaggaggaacgacgtacgactacgacgacg

SEQ ID NO: 323046 - DNA, 521 bp, Homo sapiens
  misc_feature: GZ8MTXP02IXK39.51.6.A06.1.454.CMB.2.raw
  modified_base (419)..(419): a, c, t, g, unknown or other
  misc_feature (419)..(419): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaacccacttattcttattggtaccagcagaagccaggccaggcccctgtgttgttgatatataaagacactgagaggccttcgagggactccctgagcgattctctcggctccactcgaggacaatggtcacattgacctatcagtggagtccaggcagaagacgaggctgactattctgtacaatcttnagacatcagtgtacttagtgtactcggaacttcggactaaggtcctaccgtcgtagtaccacgacccgaaggccccaaacccactcgtaccactcttacccg

SEQ ID NO: 323047 - DNA, 606 bp, Homo sapiens
  misc_feature: GZ8MTXP02HCZLP.51.6.A06.1.454.CMB.2.raw
  modified_base (310)..(310): a, c, t, g, unknown or other
  misc_feature (310)..(310): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaccctacttattcttattggtaccagcagaagccaggccaggcccctgtgttgtgatataataaagcactgagaggccttnagggactccctgagcgtattctctcggctccactcaggacaagtggtcacattgaccatcagtgagtccagcagaaagacgagctagactagttctgtacaaattcttacagtactactacgtagttaggttaacttagtcgttacgttacgggaaacgttacggggaaccctaaacgggttcccaacccggttacccgttacggggtaccgtaaccggacccccggtaaaacggaccccccgtaaaaccccctacgttaccggttaaccctaacccgtttcccgtttaacccccg

SEQ ID NO: 323048 - DNA, 656 bp, Homo sapiens
  misc_feature: GZ8MTXP02JW1S2.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctccccctcctcactctctgcacaggctctgaggcctcctatgtgctgacacagcccaccctcggtgtccgtgtccccaggacagacggccaggatcacctgctctggagatgcattgccaacccactattcttattggtaccagcagagccaggccaggcccctgtgttgttgatatataaagaccactgagaggccttcgagggctcccgtgacgcgattctctcggcctcccacctcgaggggaccaaagtcggtacactagttacgaccctattaccgaggttacgggacggtacccgaagggaccgaaagggaaacggaaccgggaacgggtaccgtacgggttaactttacgtttttacgttacggttacctaaaactttcctttaacaaacggtaaccgttaacttacccgtaagggtttacgggtttaacctttaagtttacggtttaccggttttaccggggtaaaccgtttacgggggtaaacccgtttaaaacccggggg

SEQ ID NO: 323049 - DNA, 596 bp, Homo sapiens
  misc_feature: GZ8MTXP02HD4LC.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctggtgtcccgtgtccccaggacagacggccaggatcacctgctctggagatgcattcgacccaacccacttattcttattggtaccagcagaacgccgacggccacggcccctggttcgttgttagaattaataaataaaagaccacgtagacgtacggtccttacgaaggggtacttcccgtagaacgtccgtacttctccgtcgggcccttcccgacctacgaacgggacaagtcggtacaactattacgacctatcgaaggttggacgtccgaaggccaaaggaagacggaggactagtaaccttatttacacgttaacactttactacaagtacctagtacgtagttacgtaattacgtctacggtacgtacgacgggtactaacgg

SEQ ID NO: 323050 - DNA, 522 bp, Homo sapiens
  misc_feature: GZ8MTXP02IXXTH.51.6.A06.1.454.CMB.2.raw
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (478)..(478): a, c, t, g, unknown or other
  misc_feature (478)..(478): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagctctctgtgagcctcnggattcagtctttagtacgtatggtttgcgcgtgggtccnccagggctccgaggcaaggggactgcaggtgggtggctatctatacgtcatatgaaggancataaanctacgnagactcgtagaacgggctattcacatctaccagagacaactacccaagaaacactactttactactacgaccaaatcgaaaccacccgtagacgacttagacgtacacggtngtctattagtgtacgcgagaaggtagagtacgatcaacacgacg

SEQ ID NO: 323051 - DNA, 499 bp, Homo sapiens
  misc_feature: GZ8MTXP02FH1M2.51.6.A06.1.454.CMB.2.raw
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggccccctgtgttgttgatatataaaagacactgagaggccttcagggatccctgagcgattctctggctccactcagggacaatggtcacattgaccatcagtgagtcccaggcagaagcgaggctgactagtttcngtcaatcttnagacatcagtgtacttatgtctggaactgggaccaaggtcacgtcctaggtccagcccaaggcccaaaccccactcgtcactctacg

SEQ ID NO: 323052 - DNA, 565 bp, Homo sapiens
  misc_feature: GZ8MTXP02IC1PR.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggatcacctgctctggagatgcattcgacccaaacccactatttcttattcggtaccagcagaagccaggccaggcccctgtgttgtgatatataaagacactgagaggccttcgagggactccctgagcgtattctctcggcctccacctcgagggacaagtggtacactattgacctatcagtggagtcccgaaggcaaggaagacgagctagtacttattctagtacaattcttacagtacattcgagttcggttattagtgttacgttacggaactcggggaacctacggccgtacccgtcgtacggtaccaaccgacccgaaacggaccccaacccgtactcgtaccctactccgttacccc

SEQ ID NO: 323053 - DNA, 632 bp, Homo sapiens
  misc_feature: GZ8MTXP02F7Z2V.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgcattcgacccaaccctacttattcttattggtaccagcagaagccaggccaggcccctgtgttgttgatataataaagacactgagacggccttacgagggtactccctaggacgacgtattctctcggcctccacctcgaagggacaagtcggtacactagtacgaccatcgagtcgagtccgaggcaagaagacgaggtctagtacttattcgtagtactaatcttacaagtactataccgtagttacggttacttagttcgttaccgttacgggtaacgtacggggtaaaccgtaacggttacccgtaacccggttacggttaacggtaccgaacccggaccccgaaaaccggggtaccccctaaaaccccgtacttacggtacccgtaaccttcccgttttaacccccg

SEQ ID NO: 323054 - DNA, 543 bp, Homo sapiens
  misc_feature: GZ8MTXP02HUUE1.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggatcacctgctctggagatgcattgcccaaacccactattcttattggtaccagcagagccaggccaggcccctgtgttgtgatatataaagacactgagaggccttcgagggatccctgagcgtattctctggctccacctcaggacaatggtcactattcgaccatcgagtggagtacccgaggcagaaacgacgaggctgaaccttattcctgtaccaaattcttacagaccatcaagtggttacttatgttcgttcggaacttcgggaacctaaggtccaccgttcaacgggtcacgtcccaaacggccccaaaacccctcacgtccacgttccttcccg

SEQ ID NO: 323055 - DNA, 590 bp, Homo sapiens
  misc_feature: GZ8MTXP02F1MZG.51.6.A06.1.454.CMB.2.raw
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
  modified_base (355)..(355): a, c, t, g, unknown or other
  misc_feature (355)..(355): n is a, c, g, or t
  modified_base (454)..(454): a, c, t, g, unknown or other
  misc_feature (454)..(454): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagctctcctgtgagcctntggattcagtcttcagtacgtatggttgcgtcgtgggtcccncaggcctccgaggcaaggggctggcagggtgggtgcatctatatcatatagaaaggaancaaataaactactacgacaagactccgtaggaacgggcctaattacaactaactccaccgaagaacgaacaaactaccccaaagaaccactaactttanacctagacaaatcgaaacctacccgtagacgtacgttagaacggacctacgggtacttacgttacctttaagtttaacgtttggacggacgggtaagggtaagggggaatacgttaccggaattaccgaacgaacg

SEQ ID NO: 323056 - DNA, 553 bp, Homo sapiens
  misc_feature: GZ8MTXP02HAH0U.51.6.A06.1.454.CMB.2.raw
  modified_base (296)..(296): a, c, t, g, unknown or other
  misc_feature (296)..(296): n is a, c, g, or t
  modified_base (446)..(446): a, c, t, g, unknown or other
  misc_feature (446)..(446): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgaagcctctggattcagcttcagtacgtatggtttgcgcgtgggtcccnccaggcctccgaggcaaggggctgcaggtgggtgcatctatatcatatgaaggagcaaataaatactacgcaagactccgtaggaacggaccgtattcaccaatctacccaagacgaacaaactaccccaaagaacctaactaactttanacttagaactaaacgtacgaaaccaccctagaacgtacgttagacggaccacgggtctagttactacttagttacgtgacgaaggtaggagacgtcgactcaacgag

SEQ ID NO: 323057 - DNA, 503 bp, Homo sapiens
  misc_feature: GZ8MTXP02IAG0F.51.6.A06.1.454.CMB.2.raw
  modified_base (198)..(198): a, c, t, g, unknown or other
  misc_feature (198)..(198): n is a, c, g, or t
  modified_base (295)..(295): a, c, t, g, unknown or other
  misc_feature (295)..(295): n is a, c, g, or t
  modified_base (402)..(402): a, c, t, g, unknown or other
  misc_feature (402)..(402): n is a, c, g, or t
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (480)..(480): a, c, t, g, unknown or other
  misc_feature (480)..(480): n is a, c, g, or t
  modified_base (492)..(492): a, c, t, g, unknown or other
  misc_feature (492)..(492): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtncagtctgggggagcgtggtccagcctgggaggtccctgagactctcctgtgaagcctctggattcagcttcagtacgtatggtttgcgctgggtccnccaggctccaggcaaaggggctgcaggtgggtgcatctataatcatatgaaaggaagcaaataaaatactaacgcagactccgagaagggcgatcacatctccaganacaatcccaaagactacacttttaantananaaananaacacctacgagagtagagacgacgctctactattatgtgngaaggaggaganagacacacacg

SEQ ID NO: 323058 - DNA, 614 bp, Homo sapiens
  misc_feature: GZ8MTXP02HUQ9Q.51.6.A06.1.454.CMB.2.raw
  modified_base (294)..(294): a, c, t, g, unknown or other
  misc_feature (294)..(294): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagccaccctggtcgtccgtgtccccaggacagacggccaggatcacctgctctggagatgcattcgcccaacccatattcttattggtaccagcagaanccaaggccaggcccctgtgttgttgatatataaagacactgagaggtccttcgagggctccctgacgcgtattctctcggcctccacctcgaacggggacaaagttcggtactactacttcgaccctatccgaggttcggacgttaccgagggaccaaggaaacgaccgaagggcctaggtaccttaagtttccgtagttactaaaatttccttacaaacggtacctaagttaccgtaaacggttggtttaaaccttttaagttcggtttaccgtttaccgggtaaaaccgttacggggtaaacccgtttaaaaccgggg

SEQ ID NO: 323059 - DNA, 695 bp, Homo sapiens
  misc_feature: GZ8MTXP02FUHHS.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtgggggagcgtggtccagccgtgggacgtcctgagctctctgtgagcctctggattcagcttcagttacgtatggtttgcgtcgtgggtcccgccgaggcctccgaggccgaaaggggctggacgtagggttggggtgcctagttctaatacgtcaattagtaggaaaagggaacactaaaagtaaaactaccgtaaaccgctaaacgtaccgtacccggtagggaaacggggtccctaatttacccgaaccctaacgttacccgaccaaacggaacgaaacctaaaacctacccgaaaaacgtaacctaaaccttaaccttttaacgtacccttaggaaacctaaaacttacggaaaccctacccgtaaggtaacgtaaccgtttaggaaacggactaacccgggttcttacgttacgtttaacgttacgttacggacggtacggaaggggtaagggtacgtaacgtacgtaactaccgaacgaccgg

SEQ ID NO: 323060 - DNA, 611 bp, Homo sapiens
  misc_feature: GZ8MTXP02INFGT.51.6.A06.1.454.CMB.2.raw
  modified_base (309)..(309): a, c, t, g, unknown or other
  misc_feature (309)..(309): n is a, c, g, or t
  modified_base (478)..(478): a, c, t, g, unknown or other
  misc_feature (478)..(478): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggaggtccctggagactctcctgtgaagccctctggattcagtcttcgagttacgtattggtttgccgcgtcggggtcccnccgaggcctccgaggcgaaggggactggcgaggtgggtgctagtctatatcatagtaggaaagaagactaaataaaatactacgacagacctccgtagaacgggcctattaccaacctatcctaccaagaacgaaccaactaccccgaaagaaaccaactacttttaancgttacgaacctaaaatacgaacccaccctagaacgtaccgttaggaacggtaccgacggtcttacgttacgttaactttagttacgttcggacggtaagggagggaacgtacgtacgtacgtaccaacgacg

SEQ ID NO: 323061 - DNA, 526 bp, Homo sapiens
  misc_feature: GZ8MTXP02G36FR.51.6.A06.1.454.CMB.2.raw
  modified_base (411)..(411): a, c, t, g, unknown or other
  misc_feature (411)..(411): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcagggatccctgagcgattctctcggctccacctcagggacaatggtcacattcgacatcagtgagtccagcagaagacgaggctagactattctagtcaatcttanagtacatcagtggtacttagtgttcgtacggaacgtgggacctaagggtccaaccgttcgtacggtaccacgacccgaacggcccaaaccccactacgtaccaccttcttccccg

SEQ ID NO: 323062 - DNA, 579 bp, Homo sapiens
  misc_feature: GZ8MTXP02H4YAJ.51.6.A06.1.454.CMB.2.raw
  modified_base (308)..(308): a, c, t, g, unknown or other
  misc_feature (308)..(308): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgtgatatataaagacactgagaggcctttnagggactccctgagcgtattcctctcggctcccacctcgacggggaccaaagtcggtaccactaattcgacctatccagtggacgtccgaggcaaaggaacgacgaggctgtactatttctgtcaattcttnagacntactagtggtacttagtgttacgttcggaaacttcggggaacctaaacggggttccacccggttaccgtaacgggttaccaacggaccccgaaacgggtccccaaaaccccctaccgttacgtaccctaacccg

SEQ ID NO: 323063 - DNA, 517 bp, Homo sapiens
  misc_feature: GZ8MTXP02GERUQ.51.6.A06.1.454.CMB.2.raw
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccactattcttattggtaccagcagaagccaggccaggcccctgtgttgtgatatataaagacactgagaggccttgagggactcccgtgagcgtattctcgtggcctccacctcaggacaatggtcacattgaccatcagtgagtccagcagaagacgaggctagactagttctgtacaattcttnagacatcgagtgtacttagtntcgttaggactcgggaacaggtcaccgtccgtaggtaccagacccaacggtacccaaacccgctcgtcacctcgttcccg

SEQ ID NO: 323064 - DNA, 578 bp, Homo sapiens
  misc_feature: GZ8MTXP02JJBAD.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttgagggtactcccgtgagcgtattcgtctcggcctccacctcgagggacaagtcggtacacattgaccatcagtggatcaggcaaggagacgaggctagactagttctagtactaatcttacagactatcgagttggtaacttagtcgttacgttacgaacgttcgggaaccaaggggttacccaaccggttccgtaacgggtaccgtaacggaccccgtaaaacgggacccctaaaacccccacggttacgacctaaccgttcctttcccccgg

SEQ ID NO: 323065 - DNA, 543 bp, Homo sapiens
  misc_feature: GZ8MTXP02JH4BM.51.6.A06.1.454.CMB.2.raw
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
  modified_base (352)..(352): a, c, t, g, unknown or other
  misc_feature (352)..(352): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggaggtccctgagactctcctgtgaagcctctggattcagcttcagttacgtatggtttgcgtctggggtcccncaggctccgaggcaagggctgcagtgggngcatcatatcatatgaaggaanctaaataaactacgtacgcagactcgagacggctatcactatcacagacgacaacgtaccggaacacactcgtctcgtacgacaaagtacgaacacgacgtagagacgcgtaggacggacgacggtacttagtttactacgttgtgtcgtacgtacgtcccgtacctacgtaccggttacgggtaaccggg

SEQ ID NO: 323066 - DNA, 596 bp, Homo sapiens
  misc_feature: GZ8MTXP02JBT87.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaacccactattcttattggtaccagcagaagccaggccacggcccctgtgttgtgatataataaagacactgagacggtccttacgagggactcccgtaggacgtcgtattctcgtcggtcctcccacctcgaaggacaagtcggtacactagttacgacctagtacgaggtcggacgtacccgaggacgaaggaaagacgagggctaggtacttattcgtagtacctaattcttacagtacatcgagttcggttacttagtgttcgttacggaacttcggggaacctaagggtcccaccggtactacgggtaccaccggacccgaaacggccccaaaccccgtactcgtacctaccgttccttccccg

SEQ ID NO: 323067 - DNA, 583 bp, Homo sapiens
  misc_feature: GZ8MTXP02FUAJW.51.6.A06.1.454.CMB.2.raw
  modified_base (189)..(189): a, c, t, g, unknown or other
  misc_feature (189)..(189): n is a, c, g, or t
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
  modified_base (366)..(366): a, c, t, g, unknown or other
  misc_feature (366)..(366): n is a, c, g, or t
  modified_base (441)..(441): a, c, t, g, unknown or other
  misc_feature (441)..(441): n is a, c, g, or t
  modified_base (460)..(460): a, c, t, g, unknown or other
  misc_feature (460)..(460): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcaggtcgtgggggagcgtggtccagccgtgggagtccctgagctctccgtgtgacgcctntggattcagcttcagtacgtagtggtttgcgtcgtgggtcccncgaggtctcgaggcaaaggggctggctaggtgggtgctatcgtatactcaatataggaaaggaancgtaaataaaactacgtaacgcaaaggtaccttcccggtaggaaacggggtcctaagttaccaaccctattaccnccgtaagacgaactaaacnccccaaagaacctaactactttaatcctagactaaaacgcgaaaccaccgttagactaccgtagacgacgacgtctgtacttatacgttgacgacgaaggagggatacgcgtaacacgacacg

SEQ ID NO: 323068 - DNA, 590 bp, Homo sapiens
  misc_feature: GZ8MTXP02IK8FM.51.6.A06.1.454.CMB.2.raw
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctggggagtccctgagctctcctgtgagcctctggattcagcttcagtacgtatggtttgcgtcgtgggtccgccgaggcctccgaggccaaaggggctgcaggtgggtcgcatctatatcatagtagaaaggancaaataanactacgcagactccgagaggccgatcacatctacagacacactaccaaagaacactactttacactagaacaaatacgaaacctacccgtagaacgtaaccgttaggaaacggtaccacggtaccgttaggtttacctttaacgtttaacgttcggttacggtaccgggtaaggggtaacgggggaaactaggtaaccggtaacgttacccaaacgtaacccgg

SEQ ID NO: 323069 - DNA, 623 bp, Homo sapiens
  misc_feature: GZ8MTXP02I7MPS.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagcccaccctcggtgtccgtgtccccaggacagacggccaggatcactgctctggagatgcattgccaacccactattcttattggtaccagcagagccaggccaggcccctgtgttgtgatatataaagacactgagacggccttacgagggtactccctggacgcgtattcctcgtggcctcccacctcgaacggggtactaaagtggtaccaacgtatttcggaaccctataccgaaggtagggacgttcccgaagggaccgaaaggaaacgaaccgggaggtacgtacggtaactttaagtttcgtcggttaactaaacttcctttacgaaacggtaacctacttaaccgtaaggttacgggtttaacctttagtacgtttaccggtttacggtaaaccgtcggggtaaaaccgtaaaccgggg

SEQ ID NO: 323070 - DNA, 545 bp, Homo sapiens
  misc_feature: GZ8MTXP02F1K7U.51.6.A06.1.454.CMB.2.raw
  modified_base (396)..(396): a, c, t, g, unknown or other
  misc_feature (396)..(396): n is a, c, g, or t
  modified_base (428)..(428): a, c, t, g, unknown or other
  misc_feature (428)..(428): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagcctggggaggtccctgagactctctgtgagcctctggattcagcttcagtacgtatggttgcgcgtgggtcccgcaggcctccgaggcaagggctgcaggtgggtgcatctatatcatatggaaagagcaaataaatactacgcagactccgtagaacgggccatcacatcncagacacaactccaaagaaccactaactttanctagacaaactcgaaacctaccctagacgtaacgttaggaacggtaccacgggtccttaggtacttaatttagtcggtgacggtaaggaggggaagtactacggtatacgacgaacg

SEQ ID NO: 323071 - DNA, 600 bp, Homo sapiens
  misc_feature: GZ8MTXP02JKSQT.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccaggccgtggggaggtccctgagactctcctgtgaacgcctcgtggattcagtcttcagtacgtagttggttgcgcgtggggtcccgccgaggcctccgaggacgaaggggactggacgagggtggggtcgcagtctatatacaatagtaggaaaggaagactaaataaactacgtacgacaagacctaccggtaggaacgggtcccgtatccgaacctatacctaccgaagacgaacaactacccaaaagacctaacttactttacactagaactaaactacgaacctacctagacgtacgtagaacgacgacgtctagtcttaagttacgtggtagacggaaggtacggggtagtacgtacgactacgaacgtacgg

SEQ ID NO: 323072 - DNA, 599 bp, Homo sapiens
  misc_feature: GZ8MTXP02HEK7T.51.6.A06.1.454.CMB.2.raw
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (461)..(461): a, c, t, g, unknown or other
  misc_feature (461)..(461): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtgggggagcgtggtccagccgtggggacgtccctgagactctccgtgtgaacgcctcgtggattcagcttcagttacgtattggttgcgtcgtggggtccncgaggcctcgaggcaagggctgacgaggtgggtgcagtctatancatagaggaagaancaaataactactagacaagacgtaccgtagaacgggcctaattaccgactatccaccaaggacaaccaatacccgaaaataaccaactaactttanctagaactaaaataccgaaacctacccgtagaacgtaacgtacggaacggtaaccgaacgggtctttaacggtaccttaaagtttagttcgacggtacgaagggtaacggagtacgtacggaaactccgaacgaaccg

SEQ ID NO: 323073 - DNA, 522 bp, Homo sapiens
  misc_feature: GZ8MTXP02HRG2E.51.6.A06.1.454.CMB.2.raw
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
  modified_base (454)..(454): a, c, t, g, unknown or other
  misc_feature (454)..(454): n is a, c, g, or t
  modified_base (472)..(472): a, c, t, g, unknown or other
  misc_feature (472)..(472): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatttgctgacacagccaccctcggtgtccgtgtccccaggacagacggccaggatcacctgctctggagatgcattgccaacccactattcttattggtaccagcagaagccaaggccaggcccctgtgttgttgatataataaagacacctgagaggccttnagggatcccgtgancgattctcgtgccnccactcagggacaatgacacattgaccatcagtggagtccaaggcaaggaacgacgtaggactaggacttaagtttccngtactaacttcttacganacatcagtacgttataagtgtacttcggaacgttcggaccgaagtacccg

SEQ ID NO: 323074 - DNA, 589 bp, Homo sapiens
  misc_feature: GZ8MTXP02JF6DK.51.6.A06.1.454.CMB.2.raw
  modified_base (256)..(256): a, c, t, g, unknown or other
  misc_feature (256)..(256): n is a, c, g, or t
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
  modified_base (450)..(450): a, c, t, g, unknown or other
  misc_feature (450)..(450): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttggggttttcctcgttgctcttttaagaggtgtccagtgtcaggtgcagctggtgcagtcgtgggggagcgtggtccagccgtgggagtccctgagctctctgtgagcctntggattcagcttcagtacgtagtggtttgcgtcgtcgggtcccncgaggcctccgaggcaaggggctggcgaggtgggtgctatctatntcatagtggaagaancaaataaatacgtacgnaagactcgtagaacgggccgtattcacctatcctaccgaagacaacaactacccaaagaaccactaactttanactagaacaaactcgaaacctacccgtagaacgtactaggaacggaacctacggtcttacggttacttaaagtttacgttaggtacggaacggaagggaaacggggtaacgtacgtacggaacttaccgaacgtaacgg

SEQ ID NO: 323075 - DNA, 531 bp, Homo sapiens
  misc_feature: GZ8MTXP02IQ47S.51.6.A06.1.454.CMB.2.raw
  modified_base (256)..(256): a, c, t, g, unknown or other
  misc_feature (256)..(256): n is a, c, g, or t
  modified_base (293)..(293): a, c, t, g, unknown or other
  misc_feature (293)..(293): n is a, c, g, or t
  modified_base (427)..(427): a, c, t, g, unknown or other
  misc_feature (427)..(427): n is a, c, g, or t
  modified_base (529)..(529): a, c, t, g, unknown or other
  misc_feature (529)..(529): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtgcagtctgggggaggcgtggtccagcctgggagtccctgagctctcctgtgagcctcnggatcagcttcagtacgtatggttgcgcgtgggtccncaggctccgaggcaaaggggctgcaggtgggtgcatctatatcatatagaaaggaagcaaataaatactacgcaagactcgagaaggcctatcacatctccagacgaacaactcccaaagaaccactactttancctagacctaaaatcgaaacctacccgtagaacgtacgttacgacggaccacgggtctagttactacttagttcgtggacgaaggaggacatcgatcgaacncg

SEQ ID NO: 323076 - DNA, 650 bp, Homo sapiens
  misc_feature: GZ8MTXP02JQQEP.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtgggggaggcgtggtccaggccgtggggacggtcctgacgctctcctgtgaacgcctcgtggattcagtcttcaggttacgtgttggtttgcgtcgtcgggtcccgccgaggcctcgaggacgaaggggctggcgaggtggggtgctatctatatcatagtaggaaaggaagactaaaataaaactaccgtaacgacaacggtaccgttaccgggtagggaaaccggggtacccgtaacgttacccaacccgtaactccctacccgaaacgaacgaaacctaaacctaaccccgaaaacgaaaccctaacctaacttttaactacgtacgaactaaactaacgaaaccctaccgtagaaccgtacgttaggaacggtacaccgggtctacgttacttattacgtcggtacggaggaaggagggtacacgtacgacgacaacgcg

SEQ ID NO: 323077 - DNA, 615 bp, Homo sapiens
  misc_feature: GZ8MTXP02I08VA.51.6.A06.1.454.CMB.2.raw
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
tcagcgatcgtatacacgaccggtgctcgatttagatctactgacagggggtgggtccagggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattgaccaaaccgntatgcttattggtaccagcagaagccgggccaggcccctgtgttggtgatgtaataaagacactgagacggccctgagggactccctgacgcgtattctcgtcggcctccgaggtcgaggggaaccaaaccgggttccaacgtaagttcgggaccctatcgaagggttggacgtccgaggcaggaggacgaggctagactatatgacaatacaacagaccactagttacggtacttattcgttcgttacggaactgaccgaaccgtaacggttacccaaccggttccgtcggggttaccaaccggtaccccgaaaacgggaacccccaaacccccgtacgttaccggtaccctaccgttcctttacccggtttaacccccc

SEQ ID NO: 323078 - DNA, 507 bp, Homo sapiens
  misc_feature: GZ8MTXP02GTGQ8.51.6.A06.1.454.CMB.2.raw
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (333)..(333): a, c, t, g, unknown or other
  misc_feature (333)..(333): n is a, c, g, or t
  modified_base (420)..(420): a, c, t, g, unknown or other
  misc_feature (420)..(420): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgaagcctctggattcagcttcagtacgtatggttgcgntgggtccncaggctccgaggcaagggctgcaggtgggtgcatctatancatatggaaagagcaaataaactactagcagactcgtagaggccatcacatcacagacgactaacacccaaagaccactacgtttanctagacctaaatcgaaaccacctagactactagagaccaggctagtctagttactcggtagacgaaggagggacatcgatacacacg

SEQ ID NO: 323079 - DNA, 667 bp, Homo sapiens
  misc_feature: GZ8MTXP02G8I5L.51.6.A06.1.454.CMB.2.raw
  modified_base (218)..(218): a, c, t, g, unknown or other
  misc_feature (218)..(218): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgctattcgacccaacccattattcttattggtaccagcagaacgccaggccacggcccctgtgttgtgatataataaagacactgagacggcctttacgaggtactcccgtagacgcgtattccgtctggtcctcccgtacctcgaacggggactaagttacggtccaactacgttcgaacctaagtcgagttacgggactccggaaggaccgaaggaacggacggaggtactagtactttaagtttcttaggtactaacttctttacaacgtactagttacgtaaggttacggtttaactttaagttcgtttacgttaccgggtaaacgtttacggggaaacccgttaacggttacccgtacccggttaccgtaacggtaccgtaacccggacccgaaaccgggtacccccaaaccccgtaccgttaccggtacccttaaccccgg

SEQ ID NO: 323080 - DNA, 493 bp, Homo sapiens
  misc_feature: GZ8MTXP02FKJ1L.51.6.A06.1.454.CMB.2.raw
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (439)..(439): a, c, t, g, unknown or other
  misc_feature (439)..(439): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttatggtaccagcagaagccaggccaggcccctgtgttgttgatatataaagaccactgagaggccttnagggntccctgagcgattcnctggctcacctcagggacaatggtcacattgaccatcagtggagtccaggacagaagacgaggctgactatttcngtacaatcttacagacatcagtgtaacttatgtcttcggaactgggactaacgg

SEQ ID NO: 323081 - DNA, 510 bp, Homo sapiens
  misc_feature: GZ8MTXP02FRX5E.51.6.A06.1.454.CMB.2.raw
  modified_base (295)..(295): a, c, t, g, unknown or other
  misc_feature (295)..(295): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggagtccctgagactctctgtgaagcctctggattcagcttcagtacgtatggtttgcgctgggtccncgaggctccgaggcaagggctgcaggtgggtgcatctatatcatatgaaaggaagcaaataaatactacgcaagactcgtgaagggccatcacntcncaganacaancccaaagacactactttanctagaccaaatcgaactaccctagacgtactggaagaccacggctcgtactatttagtgtcgacgaagagggacatacgactcgacacg

SEQ ID NO: 323082 - DNA, 556 bp, Homo sapiens
  misc_feature: GZ8MTXP02HI2JP.51.6.A06.1.454.CMB.2.raw
  modified_base (299)..(299): a, c, t, g, unknown or other
  misc_feature (299)..(299): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (399)..(399): a, c, t, g, unknown or other
  misc_feature (399)..(399): n is a, c, g, or t
  modified_base (435)..(435): a, c, t, g, unknown or other
  misc_feature (435)..(435): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccaggcctggggagtccctgagctctcctgtgagcctctggattcagcttcagtacgtatggtttgcgcgtggggtcccncaggctccgaggcaagggctggcgtaggtgggtgcatctatatcatangaaaggaancaaataaatactacgacagactcgagaagggccatcacatccncagacacactacccaaagaacctactaactttaacnctacgaactaaatacgaacctaccgtaggacgtacgtagaacggtaccgtacggtacttacgtacttaattacgttcggacgacggtaagggacgggtatacgtacgactaccgaacgacg

SEQ ID NO: 323083 - DNA, 671 bp, Homo sapiens
  misc_feature: GZ8MTXP02GY71F.51.6.A06.1.454.CMB.2.raw
  modified_base (520)..(520): a, c, t, g, unknown or other
  misc_feature (520)..(520): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtggggggaggcggtggtccaggccgtggggaggtccctgagctctcctgtgacgcctctggattcagtcttcgagttacgtattggttgcgtcgtgggtcccgcgaggcctccgaggcgaaggggactggcgagggtggggtcggctatctatatcaagtagtacggaaaagggaaagacctaaaagttaaaaactaccgtaaccgacgaaacggtaccgttcccgggtaaagggaaccgggacccgtaattaccaacctatcctacccgaagtaaccgaaacaaacctacccaaaagaacctaacctactttanactacgaactaaaactacgaaacctaccgtacgaacgtacgttacggaacggtacgtacgggtactttacggtacttaacgtttacgttacggtaggtaacgggtaaggaacggggtaagtacgtacccggtaaacgtaccgaacgtaccg

SEQ ID NO: 323084 - DNA, 609 bp, Homo sapiens
  misc_feature: GZ8MTXP02G0HGY.51.6.A06.1.454.CMB.2.raw
  modified_base (300)..(300): a, c, t, g, unknown or other
  misc_feature (300)..(300): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgaacgcctcgtggattcagtcttcagttacgtattggtttgcgcgtgggtccncgaggctccaggcaagggactggcaggtgggtgcagtctatatcatagtggaaaggaagcaaaattaaaatacgtaaacgccgtaaagtacctaccggtaaggaaggggacccgtaattaccaaacctataccctacccgaaggaacgtaaactaaacctaacccgaaaagaaacctaactaacttttaacactacgtaaccaaaattacgaaaccaacccgttgaacgtaacgtagaacggtactaacgggcttagtaccttaagtttactcgtgaggaaggaggggatacgtcgaactcgacgaacg

SEQ ID NO: 323085 - DNA, 636 bp, Homo sapiens
  misc_feature: GZ8MTXP02HPBZK.51.6.A06.1.454.CMB.2.raw
  modified_base (340)..(340): a, c, t, g, unknown or other
  misc_feature (340)..(340): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaacccattattcttattggtaccagcagaagccaggccacggcccctgtgttgtgatatataaagacactgagacggcctttgagggactcccgtgacgcgtattcccncgtggcctccacgtcgagggaccaagtcggtcaacgtattacgaacctagtcctaaggtggacgtccgaagggacaaggaaacgacggaaggtcttagaactttagtttacgtgtacttaaacttcttaacgaagtactatacgtagttaggtaacctttagtcgttcgttaacgggaaacgttcgggaaacccgtaagggttacccgtaacccggtccgttaacgggacccgaaccggtaccccgaaaaccggtacccccaaaacccccgtacctaccggttacccttaaccccg

SEQ ID NO: 323086 - DNA, 584 bp, Homo sapiens
  misc_feature: GZ8MTXP02HA5HP.51.6.A06.1.454.CMB.2.raw
  modified_base (296)..(296): a, c, t, g, unknown or other
  misc_feature (296)..(296): n is a, c, g, or t
  modified_base (564)..(564): a, c, t, g, unknown or other
  misc_feature (564)..(564): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgaagcctctggattcagcttcagtacgtatggtttgcgtctgggtcccnccagggcctccgaggcaaggggtactttcgaggttggggtgctatctatactcatatagaaggaagcaagtaaatacgtaacgctaagactccggtaggaaacggggtccgaattccaacccatcctacccgagaacgaaccaaactaccccaaagaaaccaacctactttaactactacgacaaaatcgaaaccacccgttagaaacgtacttagaacggtacaacgggtcttagtcttattacgttcgaggtcgaggtaagggganacgtacgagtacacgacgcg

SEQ ID NO: 323087 - DNA, 516 bp, Homo sapiens
  misc_feature: GZ8MTXP02ITDRJ.51.6.A06.1.454.CMB.2.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (296)..(296): a, c, t, g, unknown or other
  misc_feature (296)..(296): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccntattcttatggtaccagcagaancagcagccctgtgtgtgatatataaagacactgagaggccttnagggatccctgagcgattctctcggctccacctcgaggacaatggtcacgattcgaaccatcaggtgacgtccgagcaagaagacgaggctgactattctgtcaatcttacagactatgagtggtacttagtgtcttaggaacgttagggacctaggtcgaaccgtccttacggcaacgccccgaaaggcccaaacccgactcgtaccacttcttcccgg

SEQ ID NO: 323088 - DNA, 715 bp, Homo sapiens
  misc_feature: GZ8MTXP02H8P5Z.51.6.A06.1.454.CMB.2.raw
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagccaccctcggtgtcccgtgtccccaggacagacggccaggatcacctgctcgtggagatgcattcgacccaacctactatttcttagttggtaccagcagaagccaggccaggcccctgtgttgttgatataataaagacactgaaggacggtccttcgaagggactcccgtggacgcgtattctctcggcctcccacctcgacgggactaagtcggtaccactactttacgacctatccgtaagggtcgggtacgtacccgaaggggacaaacgggaaaacggaaaccgggtaacgggtacgttacggaaaccttttaacgtttccgttaggttaaccttaaaattccctttacgaacggtaacctagttaaccgtaaggttacgggtttaaactttacggtttcggttaccgtttaacgggtaaccgttacggggtaaacccgtaaacgggtcccgtaaacccggttacgtttaccggtaccgaaccgaaccccgaaacggaccccctaaaaccccgtccttacggtaccctaaccgttcccgtttccccgg

SEQ ID NO: 323089 - DNA, 555 bp, Homo sapiens
  misc_feature: GZ8MTXP02H56FR.51.6.A06.1.454.CMB.2.raw
  modified_base (171)..(171): a, c, t, g, unknown or other
  misc_feature (171)..(171): n is a, c, g, or t
  modified_base (438)..(438): a, c, t, g, unknown or other
  misc_feature (438)..(438): n is a, c, g, or t
  modified_base (451)..(451): a, c, t, g, unknown or other
  misc_feature (451)..(451): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagnggtgtccagtgtcaggtgcagctggtgcagtcgtgggggagcgtggtccagcctgggagtccctgagactctcctgtgaacgcctctggattcagcttcagtacgtatggtttgcgcgtgggtcccgcgaggcctaccgaggcgaaagggctgcgaggtgggtgcattcgtatatcgatagtggaaagagcaaaattaaactacgtacgacacgacgttccgagaacggccgtatccacatacctacagacgaacactacccaaaanaactactacttanacgtacaacaaacacgaacctacgagaacgtagtacggacgactacgtatacgtacttattacgtcgacggaggaaggacggtagtacgtacgactacgacgtg

SEQ ID NO: 323090 - DNA, 643 bp, Homo sapiens
  misc_feature: GZ8MTXP02JNZJI.51.6.A06.1.454.CMB.2.raw
  modified_base (318)..(318): a, c, t, g, unknown or other
  misc_feature (318)..(318): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccaggccgtggggacgtccctggacgactctcctggtgaacgtccctcgtggtattcagtcttacgaggttacgtagtggtttgcgtcgtcgggtcccncgaggctccgaggcgaagggctgcgtaggtgggtgctattctaatactcaagttagtaggaaaaggtaacgtactaaaattaaaactaccgtaacgactaacggtaccgttccgggtaaggaaacgggtcccgtaaattacaaactaaacttccgaccgaagaacgaaacctaaaccgtaacccaaaagaaacctaaccttaactttaactctacgaactaaaagtcgaaacctaccgtagactacgtagaacgtacgacggtctagttactagtttacgtcggtagaggaaggaggtaacgtacgtacgaacgtacaccgaacg

SEQ ID NO: 323091 - DNA, 570 bp, Homo sapiens
  misc_feature: GZ8MTXP02JRBJ4.51.6.A06.1.454.CMB.2.raw
  modified_base (258)..(258): a, c, t, g, unknown or other
  misc_feature (258)..(258): n is a, c, g, or t
  modified_base (456)..(456): a, c, t, g, unknown or other
  misc_feature (456)..(456): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggagtccctgagactctcctgtgaagcctntggattcagcttcagtacgtatggtttgcgtcgtgggtcccgcaggcctccgaggcaaggggctgcgaggtgggtgcagtctatatcatagtagaaggaagcaaataaatacgtacgcaagacctccggtagaacgggccattccaacctatcctacccaagaacgacaaactacccgaaaagaaccaactactttancctagaacctaaatcgaaaccacccgtagaacgtacgttagaacggacacgggctagtacttaagttacgtcggtagacggaagggacgggtagtacgtcggactacgaacacg

SEQ ID NO: 323092 - DNA, 686 bp, Homo sapiens
  misc_feature: GZ8MTXP02FKTCR.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgaccaacccactattcttattggtacagcagaagccagccacggcccctgtgttgtgatatataaagacactgagaggtccttcgaggatcccgtgagcgtattcctctcgcctccactcgagggacaagtcggtacactattcgacctatcgagtagggacgtacccgaagggaccaaggaaagacggagggtcttacggtaacttaactttccgttaggttactaaaactttcctttacgaaacgtaacctaagttccgtaaaggtttaggttaactttaagttcggtttaccgtttaacggggaaaaccgttacgggggtaaaaccgtaaacggggtttacccaaaccccggggttaccgttaacgggttacccgaaaccggtaccccccgaaaaacggggtccccccaaaaacccccgtaccgtaccggtttaacccacccttttcccgtttacccccgg

SEQ ID NO: 323093 - DNA, 590 bp, Homo sapiens
  misc_feature: GZ8MTXP02HGU84.51.6.A06.1.454.CMB.2.raw
  modified_base (251)..(251): a, c, t, g, unknown or other
  misc_feature (251)..(251): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccacctggtgtccgtgtccccaggacagacggccagggatcgacctgctcgtggacgatgctattcgccaacctctattcttatggtaccngcagagcagccaggccctgtcgtgtgatactataaagcacgtgagagtcttgaggactccgtgcgcgtatctacgtcgctccacctgaggacctaagtcggtccaactagttacgacctatacaggttagactacccgaggcctaaggaacgtaacggacggctacggtaactttaaggttcttacgttacctaattacgtttaccgtaaacgtactaacgtacgtacgttacgttacgttacgttacgttacgtacgtaacgtacggtacgtacgtacgtacgtacgtacgtacgacgaccgaaccgaccgacctactacgtacctacctaccgtccg

SEQ ID NO: 323094 - DNA, 524 bp, Homo sapiens
  misc_feature: GZ8MTXP02HPI0I.51.6.A06.1.454.CMB.2.raw
  modified_base (215)..(215): a, c, t, g, unknown or other
  misc_feature (215)..(215): n is a, c, g, or t
  modified_base (325)..(325): a, c, t, g, unknown or other
  misc_feature (325)..(325): n is a, c, g, or t
  modified_base (399)..(399): a, c, t, g, unknown or other
  misc_feature (399)..(399): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattgccaaccactattcttaattggtaccagcagaagccaggccaggcccctgtgtgtgatataataaagacactgagaggccttcgaggatcctgagcgtatctntcgctcactcagggacaatggtacaacattgaaccatcaggtgagccgagcagaagacgaggctgactattcgntacaaattcttacatacatacagtagtacgttattgtgtacgtaacgtacggtacgaacggtacgaccgtaccgtacgtacgacgaccgaaccgaccgaacccacctacgtacactactttcccg

SEQ ID NO: 323095 - DNA, 583 bp, Homo sapiens
  misc_feature: GZ8MTXP02H98JS.51.6.A06.1.454.CMB.2.raw
  modified_base (356)..(356): a, c, t, g, unknown or other
  misc_feature (356)..(356): n is a, c, g, or t
  modified_base (448)..(448): a, c, t, g, unknown or other
  misc_feature (448)..(448): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggaggtccctgagactctcctgtgagcctctggattcagcttcagtacgtatggtttgcgcgtgggtcccgccgaggcctccgaggcaagggctggcaggtgggtgcatctatatcatatgaaggaancaaataaatactaacgcaagacgtccgtagaacgggccgattccaaccatcctaccaagacgaacaactacccaaagaaccaactactttanctagaaccaaatacgaacctacccgtagaacgtacgttaggacggtaaccgacggtcttacggttaccttaatttacgttacggtcggtacggaaggtagggggtaagtacgtaacggacttaccgaacgtacgg

SEQ ID NO: 323096 - DNA, 563 bp, Homo sapiens
  misc_feature: GZ8MTXP02HSK5P.51.6.A06.1.454.CMB.2.raw
  modified_base (295)..(295): a, c, t, g, unknown or other
  misc_feature (295)..(295): n is a, c, g, or t
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctggggagtcctgagctctcctgtgaagctctggattcagtcttcagtacgtatggtttgcgtctgggtccncgaggctccgaggccaagggactgcgaggttgggngcatctatatcatatagaaggaanactaaataaanactacgacacgtacctcgagaacggaccactacactactcacagacacacaccaaanaactactacttacngtacaacaaatacgaaccacgtagaacgtacgtacggaacggtaccgacggtacttacgttaaccttaagtttacgttcggtacggacggaagggtaacgggacgtacgtacgtactacgaacgacg

SEQ ID NO: 323097 - DNA, 517 bp, Homo sapiens
  misc_feature: GZ8MTXP02IQ22O.51.6.A06.1.454.CMB.2.raw
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagccaccctcggtgtccgtgtccccaggacagacggccaggatcacctgctctggagatgcattgcccaacccactattcttattggtaccagcagaagccaggccaggcccctgtgttgttgatatataaagacactgagaggccttcgagggactccctgagcgattctctggcctccacctcagggacaatggtcacattgaccatcagtgagtccaggcagaagacgagctgactattctagtctaatcttcagacatctagtgtacttatgttactacggactgggactaaaggtcgaaccgtcgtacgtcacgacccaacggccccaaacccactcgtacctactcttcccg

SEQ ID NO: 323098 - DNA, 588 bp, Homo sapiens
  misc_feature: GZ8MTXP02H5TIL.51.6.A06.1.454.CMB.2.raw
  modified_base (304)..(304): a, c, t, g, unknown or other
  misc_feature (304)..(304): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
  modified_base (449)..(449): a, c, t, g, unknown or other
  misc_feature (449)..(449): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgaacgcctctggattcagtcttcaggtacgtattggtttgcgtcgtggggtccccnccgaggcctccgaggcaaaggggctgcgaggtgggngcatctatatcaatatgaaaggaancaaataaatccagcaagactccgtagaacggcctattccacatctaccagacgaaccactacccaaagaactactaacttttanactagaacaaatacgaaacctacccgtagaacgtacttaggaacggaccgacggtacttacgtaccttaagtttacgttaggttacggacggtaagggaagggggtaagtaacgttacggaacttaccgaacgtaacgg

SEQ ID NO: 323099 - DNA, 589 bp, Homo sapiens
  misc_feature: GZ8MTXP02I7U9F.51.6.A06.1.454.CMB.2.raw
  modified_base (296)..(296): a, c, t, g, unknown or other
  misc_feature (296)..(296): n is a, c, g, or t
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
  modified_base (455)..(455): a, c, t, g, unknown or other
  misc_feature (455)..(455): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggagtccctgagactctcctgtgaagcctctggattcagcttcagtacgtatggttgcgcgtgggtccncgaggctccaggcaagggactgcaggtgggngcagtctatatcatatgaaaggancaaataaaatactacgacaagactccggtagaaacgggcccgattccgaacctatcctaccaagaacgaaccaaacgtacccaaagaaaccaactaactttaanccttagaacctaaaagtcgaaaaccctacccgtagaacgtacgttagaacggtaccgtacgggacttcggtacttaacgtttagttcgtaggacgaaggaacggggaagacgttacggacttacgaacgaacgg

SEQ ID NO: 323100 - DNA, 524 bp, Homo sapiens
  misc_feature: GZ8MTXP02J0KQL.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggcagacggccaggatcacctgctctggagatgcattgccaacccactattcttattggtaccagcagaagccaggccaggccccctgtgtgttgatatataaagacactgagaggcctttcagggatccctgagcgattctctcggctccactcaggggacatggtacacatttgaccatcaagtgagtcccgaggcagaaagacgaagggctagactatttctgtcaaattctttacagacatcagtggttacttagtgttcgttcgaaacgtgggaccaaggtcaccgtcctaacggtcagcccaagccaaccccgactcgtaccactcgttcccg

SEQ ID NO: 323101 - DNA, 629 bp, Homo sapiens
  misc_feature: GZ8MTXP02GYBT8.51.6.A06.1.454.CMB.2.raw
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (300)..(300): a, c, t, g, unknown or other
  misc_feature (300)..(300): n is a, c, g, or t
  modified_base (359)..(359): a, c, t, g, unknown or other
  misc_feature (359)..(359): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtggggagtccctgagactctcctgtgagcctntggattcagcttnagttacgtatggttgcgcgtggggtcccncgaggcctccgaaggcgaaaggggctggctaggtggggtgcaagtctaatatcaagtanaggaaaaggaagactaaaataaaactactacgacctaaggaccttcccggtaggaacgggacccgtaattccaacccaatcctacccgaagaacgaacaaactacccaaagaaaccactaactttatacctagaaacctaaaactcgaaaaccctaccctaaggtaacgtaccgttaggaaacggtaacccgaccgggtattacggtacctttaaactttacgttacggttagacggaaggtaacggaaggtactacgactacgacaacg

SEQ ID NO: 323102 - DNA, 682 bp, Homo sapiens
  misc_feature: GZ8MTXP02F01KW.51.6.A06.1.454.CMB.2.raw
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcaggtcgtgggggagcgtggtccagccgtgggacgtccctgagactctcctgtgagcctntggatcagtcttnagtacgtattggttcgcgtcgtgggtccgccgaggcctccgaggcgaaggggctggcgagggttggggtgctagttctatactcaatagtaggaaaggaagacgtaaaataaaattaccgacgcaaacggtaccgttaccggtaagggaaacggggcccgtaacttccgaacctattacccacccgaaggaaacgaaccaaaaccctacccgaaaaggtaaaaccctaacgttaaaccttttaactaccgttaacgaaacctaaaacgtacgaaaaccctacccgtagaacgtaacgttacggaaacggaccgtacgggtcttacggttaaccttaagtttaacgtttgggtaccggaacggaaaggggtaaggggtacgtaacgtacggtaacttaccgaacgaaacgg

SEQ ID NO: 323103 - DNA, 690 bp, Homo sapiens
  misc_feature: GZ8MTXP02F1TWK.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctctatgtgctgacacagccaccctcggtcgtccgtcgtccccaggacagaccggccaggatcacctgctcgtggagatgcattcgacccaacccacttattcttattcggtaccagcagaacgccaacggccacggcccctgtcgttgttagacttataataaaacgacctactagaaggacggtccttacgaacggggtactccccgtaggtaaggtaccgtaacgtttcccttacgtcgggtaccctaccctacccgttacggaaacggggaacctaaagttcgggtacctaacgtagtttaccgaaccacttaccgaggttaggaaccggttaccgacgggacgaaaggaaaacggaccggaagggtacccttagtaaacccgtttagttttactacggttaaccttaagttaccctttacggaaacgttaaaccctagttaaccgtaggtttacggtaacttagttacgttacgttacggtaacggtccggggtaactttaaccggg

SEQ ID NO: 323104 - DNA, 497 bp, Homo sapiens
  misc_feature: GZ8MTXP02H9CFT.51.6.A06.1.454.CMB.2.raw
  modified_base (385)..(385): a, c, t, g, unknown or other
  misc_feature (385)..(385): n is a, c, g, or t
  modified_base (388)..(388): a, c, t, g, unknown or other
  misc_feature (388)..(388): n is a, c, g, or t
  modified_base (416)..(416): a, c, t, g, unknown or other
  misc_feature (416)..(416): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagccctctggattcagcttcagtacgtatggttgcgctgggtcccgcaggctccaggcaagggctggcaggtgggtgcatctatatcatatgaaggaagcaaataaatactacgcagactccgagaggcatcacntcncagagacactccaaagaacacactttanactagacaaatcgaacacctgacgacttgagacacggtatcgtactattatgtgacgtaagaggagactacgatacacacg

SEQ ID NO: 323105 - DNA, 538 bp, Homo sapiens
  misc_feature: GZ8MTXP02HCOU1.51.6.A06.1.454.CMB.2.raw
  modified_base (366)..(366): a, c, t, g, unknown or other
  misc_feature (366)..(366): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgcccaacccatattcttattggtaccagcagaagccaggccaggcccctgtgttgtgatatataaagacactgagaggccttcgagggactcccgtgagcgattctctcggctccactcgagggacaatggcacattgaccancagtgagtccaggcagaagagagctgactatttcngtacaatcttanagactatctagttcggttattagtgtacgttaggaacgttacggacctaggtaccaccgtaccgtacggtaccacgtacccgaaggtcccccaaacccgtactcgtaccctactccgtttccccg

SEQ ID NO: 323106 - DNA, 646 bp, Homo sapiens
  misc_feature: GZ8MTXP02HBU5E.51.6.A06.1.454.CMB.2.raw
  modified_base (307)..(307): a, c, t, g, unknown or other
  misc_feature (307)..(307): n is a, c, g, or t
  modified_base (383)..(383): a, c, t, g, unknown or other
  misc_feature (383)..(383): n is a, c, g, or t
  modified_base (595)..(595): a, c, t, g, unknown or other
  misc_feature (595)..(595): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggagcgtggtccagccgtgggacgtcctgacgctctctgtagacgtcctcgtggtattcagtcttacagtacgtagtggttgcgtcgtgggtcccncgaggcctccgaggcgaagggactggcgtagggtggggtcgactagttcaagtatcaagtagtaggaaaaggtaanactaaaattaaaacgtaccgtaaccgacgtaacgtacccgttaccgggtaacggaaacgggtaccctaacttacccgaacctacgtacccgtaaccgaagaaccgaaacctaaacccgtaaaccccaaaagaaacccttaacttaacctttaacgactacgaaactaaacgtacgaaacccaccgtagaacgtacgtagaacgacgtacgtntacgtacttagttacgtcgtaggacgtaaggaggacacacgacacgacgcg

SEQ ID NO: 323107 - DNA, 653 bp, Homo sapiens
  misc_feature: GZ8MTXP02ILU90.51.6.A06.1.454.CMB.2.raw
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggaggcgtggtccagccgtgggagtccctgagctctctgtgagcctntggtattcagtcttcagtacgtagttggttgcgcgtggtccncgaggctaccgaggcgaagggctggcgaggtgggtgctatctatactnatagtaggaaaggaanacgtaaaattaaactaccgtaaccgactaacgtaaccgttaccggtaggaaacgggtcccgtaattacccaacctaacttaccctaacccgaagaaaccgaaacctaaaacctaccccgaaaacgaaaccctaacttaaacctttttaacaccgttaacgaaacctaaaacgtacgaaaccctaaccgtagaacgtacgttaggaacgtaaccgtacggtcttagttacttaagtttacgttacggtacggaacggtaaggaaggggactacgtacgtactacgaacgacg

SEQ ID NO: 323108 - DNA, 500 bp, Homo sapiens
  misc_feature: GZ8MTXP02F8Z42.51.6.A06.1.454.CMB.2.raw
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (401)..(401): a, c, t, g, unknown or other
  misc_feature (401)..(401): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagagccttgagggatccctgagcgattcgtctcggcctccacctcagggacaanggtcacattgaccancagtgagtccgagcagaagacgaggctagactatttntgtcaatcttacagacatcagtgtacttatgtctgaactggacagtcaccgtcgtgtacgacgccaacggcccaaaccctctcgtaccactcgttcccg

SEQ ID NO: 323109 - DNA, 569 bp, Homo sapiens
  misc_feature: GZ8MTXP02I8DH6.51.6.A06.1.454.CMB.2.raw
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
  modified_base (362)..(362): a, c, t, g, unknown or other
  misc_feature (362)..(362): n is a, c, g, or t
  modified_base (446)..(446): a, c, t, g, unknown or other
  misc_feature (446)..(446): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggacgtccctgagactctcctgtgagcctntggattcagtcttcagtacgtagtggttgcgtcgtgggtcccncgaggcctccgaggcgaagggctggcgaggtgggngctatctatatcatagtagaaagganacaaataaatactacgcaagacctcgagacggccatccgactatcctaccagacaacaactacccaaagaccacttaactttanacctagtaaacccaaagtccgaaccctaccgtaaggactaacgtaggaacgaacgtacggtacttgtacttagtttacgtcggagtacggaaggaggtaacgtagtaccgtaacacgacgacg

SEQ ID NO: 323110 - DNA, 558 bp, Homo sapiens
  misc_feature: GZ8MTXP02HLFTZ.51.6.A06.1.454.CMB.2.raw
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatccacctgctcgtggagatgcattcgacccaaacccctacttattccttattcggtaccagcagaagccgagccacggcccctgtgttgtgatatataaagccactgagngcttgaggtctcccgngagcgtattctactggcctaccacctcaacgggactaagtcggtacacgtattcgaccatacgaggtgacgtccgaaggcaacgaagacggagtctagtacttattcgtagtactacttcgtctaagactattacgaggtttagtaacctttagttcggttacgttaacggtacgttacggggtaacctaacggg

SEQ ID NO: 323111 - DNA, 572 bp, Homo sapiens
  misc_feature: GZ8MTXP02HN6Q5.51.6.A06.1.454.CMB.2.raw
  modified_base (299)..(299): a, c, t, g, unknown or other
  misc_feature (299)..(299): n is a, c, g, or t
  modified_base (469)..(469): a, c, t, g, unknown or other
  misc_feature (469)..(469): n is a, c, g, or t
  modified_base (481)..(481): a, c, t, g, unknown or other
  misc_feature (481)..(481): n is a, c, g, or t
  modified_base (519)..(519): a, c, t, g, unknown or other
  misc_feature (519)..(519): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagctctcctgtgaagcctctggattcagcttcgagttacgtatggtttgcgcgtggggtcccncaggctccgaggcaaggggctggcgaggtggggtgcatcgtatactcatagtggaaaggaagacaaagttaaaactaccgtaacgacaagaccttcccggtagaacgggacccgattaccgacctatcctaccaagacgaacaactacccaaagaactactaacttttanactagactaaanacgaaccacccgtgaacgtacttaggacggacacggtntcgtacttattacgtgtagacggaaggtagggagtacgtcgactcgaacgacg

SEQ ID NO: 323112 - DNA, 707 bp, Homo sapiens
  misc_feature: GZ8MTXP02FYGUX.51.6.A06.1.454.CMB.2.raw
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (364)..(364): a, c, t, g, unknown or other
  misc_feature (364)..(364): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggacgtcctgagactctctgtgagcctgtggattcagtcttcagttacgtnttggttgcgcgtgggtcccncgaggcctcgaggcaagggctgcgaggtgggtgctagtctatatcaattagtaggaaaagggtaanactaaaataaaactaccgtaaccgactaacggtaccgtacccgggtagggaaaccgggggtcccgtaatttacccgaaccctaacgttaccctacccggaaagtaaaccggtaaaccctaaaacctacccccgaaaaaggtaaaccctaaccgtttaaaccctttttaacaccgttacggaaaacctaaaaacgttaccgaaaacccctacccccgttaggaaaccgtaaccgttacggaaaccggtaaccgtaccgggtcttacggttaccttaaacgtttacgttggtacggaacggaaggggtacggggaagtacgttacggtaactaccgaacgaaccg

SEQ ID NO: 323113 - DNA, 537 bp, Homo sapiens
  misc_feature: GZ8MTXP02FSXZ6.51.6.A06.1.454.CMB.2.raw
  modified_base (416)..(416): a, c, t, g, unknown or other
  misc_feature (416)..(416): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaaacccactattcttattggtaccagcagaagccaggccaggcccctgtgttgttgatatataaagacactgagaggccttcgagggatccctgagcgtattctctcgcctccacctcagggacaatggtcacattgaccatcagtgatccaggcagaagacgaggctgactattctgtcaaatcttcanacatcagtgtacttatgtacttacggaactgggaacctaaagggtcctaacccgtcttaacgggtcaacggaccccaaaacgggaccccaaaaccccgtactcgtacctactcctttcccg

SEQ ID NO: 323114 - DNA, 572 bp, Homo sapiens
  misc_feature: GZ8MTXP02IFXTO.51.6.A06.1.454.CMB.2.raw
  modified_base (446)..(446): a, c, t, g, unknown or other
  misc_feature (446)..(446): n is a, c, g, or t
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagccaccctggtgtccgtgtccccaggacagacggccaggatcacctgctcgtggagatgcattcgaccaaacgatatgcttattggtacagcagaacgccgggcacggcccctgtgttggtgatagtaataaagactaacgtgaggacggccctacgaggggtactcccgtagacgcgtattctcgtcggcctccgaggtcgaacgggaccaacgggtcacgtagttcggacctatacgaggtggacgtccgaggacaggaaggacgagctagacttattatgtanaatacgaacagaccactagtttaggtacttagtcgttcgttacgactgaccgaacgtaacggtcaccggtcgtcggtaccacgacccgaacggcccaaaccctctcgtacctcttctacttccccc

SEQ ID NO: 323115 - DNA, 532 bp, Homo sapiens
  misc_feature: GZ8MTXP02HITDT.51.6.A06.1.454.CMB.2.raw
  modified_base (296)..(296): a, c, t, g, unknown or other
  misc_feature (296)..(296): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (468)..(468): a, c, t, g, unknown or other
  misc_feature (468)..(468): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggtttgcgcgtgggtccnccaggctccgaggcaaagggctgcaggtgggtgcatctatncatatgaaggaancaaataaactacacgcagactcgagacggctatcacntcacagaacacacaccaaanaacactactttanctanacaaatacgaactaccgtagacgtacgtaggacgtacgacggtnttacgtacttagttacgtcgtacgacggaaggtacgggaacgtacgtacgacgtacgaacgacg

SEQ ID NO: 323116 - DNA, 558 bp, Homo sapiens
  misc_feature: GZ8MTXP02GEVJ0.51.6.A06.1.454.CMB.2.raw
  modified_base (298)..(298): a, c, t, g, unknown or other
  misc_feature (298)..(298): n is a, c, g, or t
  modified_base (468)..(468): a, c, t, g, unknown or other
  misc_feature (468)..(468): n is a, c, g, or t
  modified_base (488)..(488): a, c, t, g, unknown or other
  misc_feature (488)..(488): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgaagcctctggattcagtcttcagtacgtatggtttgcgtcgtgggtccncaggcctccgaggcaagggctgcgaggtgggtgctatctatatcaatataggaaaggaagcaaaattaaactactacgacaagtaccgtcccggtagaaacgggggccctaattcccaacctatcctacccaagaacgaaccaaactacccaaagaaccaactactttanactagacaaagtcgaaaccncccgtagacgtactgaacgacgacggtctagtctattagtcgtgacgaagtagggananacgatcacacg

SEQ ID NO: 323117 - DNA, 576 bp, Homo sapiens
  misc_feature: GZ8MTXP02GX33U.51.6.A06.1.454.CMB.2.raw
  modified_base (235)..(235): a, c, t, g, unknown or other
  misc_feature (235)..(235): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccntattcttattggtaccagcagaagccaggccaggcccctgtcgttgttgatatataaagacactgagaggccttcgagggtatcccgtgagcggattcctcgtgctccactcgagggacaatggtcacgattcgacatcagtgagtccaggcagaagacgtaggctagacttatttctagttactaatcctttacacgaactattaccgagttggttaacttagtgttccgttacgggaacgttcgggaacctaagggttcctacccggttccgtaacggttccgaaccggtacccccgaaacggaccccaacccccgtacgttaccggaccttaaccccg

SEQ ID NO: 323118 - DNA, 528 bp, Homo sapiens
  misc_feature: GZ8MTXP02FOBGG.51.6.A06.1.454.CMB.2.raw
  modified_base (300)..(300): a, c, t, g, unknown or other
  misc_feature (300)..(300): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (435)..(435): a, c, t, g, unknown or other
  misc_feature (435)..(435): n is a, c, g, or t
  modified_base (515)..(515): a, c, t, g, unknown or other
  misc_feature (515)..(515): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccaggcctgggaggtccctgagactctcctgtgagcctctggattcagcttcagtacgtatggttgcgcgtggggtcccnccaggcctccgaggcaagggctgcaggtgggtgcatctatatcatataggaaagaagcaaataaatactacgcagactcgtagaaggccatcacntacnccagacgacaactacccaaagaaccactactttacnctagacaaactcgaaaccacctagacgtactaggaacgacgacggtctacgtacttatttacgtcgtgacgaaggagganagtcgatcacacg

SEQ ID NO: 323119 - DNA, 528 bp, Homo sapiens
  misc_feature: GZ8MTXP02JW8TJ.51.6.A06.1.454.CMB.2.raw
  modified_base (297)..(297): a, c, t, g, unknown or other
  misc_feature (297)..(297): n is a, c, g, or t
  modified_base (351)..(351): a, c, t, g, unknown or other
  misc_feature (351)..(351): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (510)..(510): a, c, t, g, unknown or other
  misc_feature (510)..(510): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagcctggggagtccctgagactctcctgtgagcctctggattcagcttcagtacgtatggtttgcgctgggtccnccaggctccaggcaagggactgcaggtgggtgcatctatatcatatgaaaggancaaataaatacagcagactcgtagagggccatcaccntcnccagacgacaactacccaaagaacactactttatactagacaaatcgaaaccaccctagacgtacttgaacggtaccacggtctacgtacttattacgttcgtgacggaagacgggganacgtacgataccgatacg

SEQ ID NO: 323120 - DNA, 670 bp, Homo sapiens
  misc_feature: GZ8MTXP02IY3KV.51.6.A06.1.454.CMB.2.raw
  modified_base (189)..(189): a, c, t, g, unknown or other
  misc_feature (189)..(189): n is a, c, g, or t
  modified_base (370)..(370): a, c, t, g, unknown or other
  misc_feature (370)..(370): n is a, c, g, or t
  modified_base (514)..(514): a, c, t, g, unknown or other
  misc_feature (514)..(514): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcagtcgtgggggagcgtggtccagccgtgggagtccctgagactctctgtgacgtcctgtggattcgagtcttcagttacgtagttggttgcgtcgtgggtccccgcaggctccgaggcgaaagggctggcgaggtgggtgctattctaatatcatacgtaggaaacggaanactaaaataaactaccgtacgcaacgtactccggtagggaacgggaccctaattacccgaactaacgttcccgtacccgaaaggaaccaaacctaaaccgtaacccccgaaaaagtaaccctaaaccttaaacccgtttttaanacccgtaagaaacctaaaacgtaccgaaaccctaccgtaaggaacgtaccgtaacgggaacgtaaccgtacggttacttacgttacgttaaagtttcgttcggaacggacgggtaaggaacggggtaactaacggacgtaacgtaccgaaacgacg

SEQ ID NO: 323121 - DNA, 549 bp, Homo sapiens
  misc_feature: GZ8MTXP02F5ES2.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgaccaacccatattcttattggtaccagcagaagccaggccaggcccctgtgttgtgatatataaagacactgagaggccttcgagggactccctgagcgattctctggcctccactcagggaccaatggtcactattgaccatcagtgagtccaggcagaagacgaggctgacttattctagtacaatcttcagactatcagttggttacttagtcgttactttacggaacgttacgggacctaagggtcctaccgttaccgtacggtaccacggacccaacgggaccccaaaccccgtactacggtacaccttcgtttaccccg

SEQ ID NO: 323122 - DNA, 585 bp, Homo sapiens
  misc_feature: GZ8MTXP02JGKWS.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaaccctattattcttattggtaccagcagaagccaggccaggccctgtgtgtgatatataagacactgagacggcttgagggactcccgtgacgtcgattctcgtcggcctaccacctcgacgggacaagtggtaccaactattcgacctatccgaggtacggagtaccgaggacaaaggaaggacgagggtctacgacttatttcgtagtctaaattcttacgataccatcgtagtggttaacttagtcgttacgttacggaacttcggggacctaaggtccgtaaccgtaccgtacggtaccacggtacccgaacggtccccaaaaccctcggtactacccacgttccgttccccg

SEQ ID NO: 323123 - DNA, 501 bp, Homo sapiens
  misc_feature: GZ8MTXP02JE6S3.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgaccaacccacttattcttattggtaccagcagagccagccaggccctgtgtgtgatatataaagacactgagaggccttcgagggactccctgagcgattctctcggctccacctcgaggacaatggtcacattcgaccatcagtgatccaggcagaagtacgaggctagactattctgtacaatcttacatacatcgagtggtacttagtgtcttagactgggacctaggtaccacgtcctagcacgaccaacggccaacctactcgcactctcccg

SEQ ID NO: 323124 - DNA, 524 bp, Homo sapiens
  misc_feature: GZ8MTXP02HBLID.51.6.A06.1.454.CMB.2.raw
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
  modified_base (391)..(391): a, c, t, g, unknown or other
  misc_feature (391)..(391): n is a, c, g, or t
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
  modified_base (470)..(470): a, c, t, g, unknown or other
  misc_feature (470)..(470): n is a, c, g, or t
  modified_base (505)..(505): a, c, t, g, unknown or other
  misc_feature (505)..(505): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccaggcctgggagtccctgagactctctgtgaagcctntggattcagcttcagtacgtatggtttgcgcgtgggtcccnccgaggctccgaggcgaagggctggcaggtggngcatctatancatatagaaggaancaaataaatacacgnacgacgtcgagacggcatacacntcacagacacacaccaaanacactacttanctagaacaaanacgaaacctaccgtagaacgtacgtagacgacgacgtntacgtattagttacgtcgtacgacggaaggagganacgtacgactacgacgacg

SEQ ID NO: 323125 - DNA, 590 bp, Homo sapiens
  misc_feature: GZ8MTXP02H4SS7.51.6.A06.1.454.CMB.2.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (319)..(319): a, c, t, g, unknown or other
  misc_feature (319)..(319): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccacctcggtgtccgtgtccccaggacagacggccaggatcacctgctctgganatgcattgccaacccatattctaattggaccagcagancaggccaggccctgtgttgtagatatataaagacactgagaggccttacaggtatcctgagcgatcnctgctccactcaggacaatgtacactattgaaccagttcaagggtgacgtacgagacgaaggaaacgacggagtcgtagtaacttacgttacgtacgttactaacttcgttaacaagtaacgtaactacgtacgttacgttacgttacgttacgttacgtacggtaacggtaacggtaaccgtaacggtaccgtaaccgtaccgtacgtaccgaaccgaacccgaaccgtaacccgaacccgtaccgtaccgtaccgtaccttaccgtccg

SEQ ID NO: 323126 - DNA, 525 bp, Homo sapiens
  misc_feature: GZ8MTXP02F23NA.51.6.A06.1.454.CMB.2.raw
  modified_base (426)..(426): a, c, t, g, unknown or other
  misc_feature (426)..(426): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccactattcttattggtaccagcagaagccaggccaggcccctgtgttgttgatatataaagacactgagaggccttcgagggatccctgagcgattctctcggctccacctcagggaccaagtggtacacattgacctatcagtgagtccaggcagaagacgaggctaggacttagtttctagtactaaatcttanagtaacatcgtagtggttacttatgttactcggaactcgggaccaggtcaccgtctacggtcacgacccaaggcccaacccactcgtcacctcttcccg

SEQ ID NO: 323127 - DNA, 698 bp, Homo sapiens
  misc_feature: GZ8MTXP02GXZR1.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaacctacttattcttattggtaccagcagaagccaggccaggccctgtgttgtgatatataaagacactgagagccttgaggactccctgacgcgtattctctcggcctccactcgaacgggacaagtcgggtacaactacgttcgaccagtcgagtagggatcccgaggacaaggaacgtaacggacgggaccttaggtaactttacgtttactacggttactaaaattccctttacgaaacggttacctaattaccgtaaggttacggtttaaacctttaagttcggtttaaccggttacggggtaaaaccgtttaccgggggaaaaccgttaaacggggttacccgtaaacccgggtttacccggtaaaacggttcccggaaaccggtacccccgtaaaaccggggaccccctaaaaccccccggtaacttccggtacccctaaacctttaccggtttacccccccg

SEQ ID NO: 323128 - DNA, 537 bp, Homo sapiens
  misc_feature: GZ8MTXP02I3UGW.51.6.A06.1.454.CMB.2.raw
  modified_base (296)..(296): a, c, t, g, unknown or other
  misc_feature (296)..(296): n is a, c, g, or t
  modified_base (351)..(351): a, c, t, g, unknown or other
  misc_feature (351)..(351): n is a, c, g, or t
  modified_base (437)..(437): a, c, t, g, unknown or other
  misc_feature (437)..(437): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgagcctctggattcagcttcagtacgtatggttgccgcgtgggtcccncaggcctccgaggcaagggctgcaggtgggtgcatctatatcatagtgaaaggancaaataaataccgtacgcaagactccgtagaacgggccattcgaccagtctccagacgaacaactcccaaagaaccactactttanacctagacaaatgaacaccctagacgacgtagaagtacgacggtctacgtacttaattacgttcggtgacggtaagacgggagtactacgactcgacacg

SEQ ID NO: 323129 - DNA, 579 bp, Homo sapiens
  misc_feature: GZ8MTXP02G4KBK.51.6.A06.1.454.CMB.2.raw
  modified_base (555)..(555): a, c, t, g, unknown or other
  misc_feature (555)..(555): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtaaagcctctggattcagcttcagtacgtatggtttgcgctgggtccgccaggctccgaggcaagggctgcaggtgggtgcatctatatcatagtagaaggaagcaataaatactaacgcaagacctccggtagaaacgggccgaattccaacgatccgtaccagacgaacaaactaccccaaagaaaccactaactttactctagactaaaatcgaaaccacccgttagaacgtaccgttaggaacgggaacctacggggtccttaggtaccttaatttaacgttggtacgacgaaggaagggganacgttcgaagtccaacgacgaccg

SEQ ID NO: 323130 - DNA, 559 bp, Homo sapiens
  misc_feature: GZ8MTXP02JBO0U.51.6.A06.1.454.CMB.2.raw
  modified_base (338)..(338): a, c, t, g, unknown or other
  misc_feature (338)..(338): n is a, c, g, or t
  modified_base (541)..(541): a, c, t, g, unknown or other
  misc_feature (541)..(541): n is a, c, g, or t
  modified_base (548)..(548): a, c, t, g, unknown or other
  misc_feature (548)..(548): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgctattcgacccaaacccacttattcttattggtaccagcagaacgcaggccaggcccctgtgttgtgatatataaagacactgagaggccttcgagggtactcccgtgacgcgtattctntcggcctccactcgagggacaagtggtcacgtattcgacctatcaggtgacgtccgaggacaaggaagacgaggctagacttattctagtctaagtctttcagtacatcgagttggtacttagtgttacgtacggaacgtcgggaacgtaacggtcctaaccggtccgttacgtacgacgacccgaacggcccaaaccctacncgtaccncgttcttcccg

SEQ ID NO: 323131 - DNA, 839 bp, Homo sapiens
  misc_feature: GZ8MTXP02JVRXN.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggccctgtgttgtgatataataaagacactgagaggtccttcgagggtactccccgtggacgtacgtattcctcgtcggtccctacccgtaccctcgaacggggaacctaaagttcggggtaccaaacgtactttacggaacccctaagttacccgaagggtttacggggaaccgtttaccccggaaaggggtacccgaaaagggtaaaacgggtaaaaccggggaaacgggggtcccgtttaagggtaaacccgtttaaatttttaccccgttaaggttaacccgttaaaaacgttttcccccgtttaaacgtaaaccggtaaaccgttaaacgttaaccggttaaacgggtttacggttttaaccgtttaacggtttccggtttaccggtttaaccggggtaaaaccggttaccgggggtaaaacccgttaaaccggggtacccgtaaccccgggttaacccggttaaccgggtaccccgtaacccggaacccccggtaaacccgggtaacccccccgtaaaacccccgtaccgttacccgttaccccgtaacccgtttaccccgtttaccccg

SEQ ID NO: 323132 - DNA, 532 bp, Homo sapiens
  misc_feature: GZ8MTXP02FUYDM.51.6.A06.1.454.CMB.2.raw
  modified_base (298)..(298): a, c, t, g, unknown or other
  misc_feature (298)..(298): n is a, c, g, or t
  modified_base (407)..(407): a, c, t, g, unknown or other
  misc_feature (407)..(407): n is a, c, g, or t
  modified_base (441)..(441): a, c, t, g, unknown or other
  misc_feature (441)..(441): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggaggtccctgagactctcctgtgagcctctggattcagcttcagtacgtatggtttgcgcgtgggtcccnccaggcctccgaggcaagggctgcaggtgggtgcagtctatatcatagtaggaaaggaagcaaataaatacgtacgacaagacctcgtagaacgggccatcaccatccnccagacgacaactcccaaagaaccactactttanctagacaaagtcgaaccaccgtagacgtactgaggacacggctagtactattacgttgcgaggaaggaggagtaacgtcgaactcacgacg

SEQ ID NO: 323133 - DNA, 522 bp, Homo sapiens
  misc_feature: GZ8MTXP02GEXP8.51.6.A06.1.454.CMB.2.raw
  modified_base (326)..(326): a, c, t, g, unknown or other
  misc_feature (326)..(326): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
  modified_base (428)..(428): a, c, t, g, unknown or other
  misc_feature (428)..(428): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggttgcgcgtgggtcccgcaggctccgaggcaagggctgcaggtgggngcatctatatcatatgaaaggaagcaaataaatactacgcaagacctccgtagaacgggcccatcacatcnccaganacaataccaaanaacactactttanctagacaaatgaaccacctagagtactagacgtacacggtctacgtactattagtagtcgaggtaaggaggggacagtacgataccgacgaacg

SEQ ID NO: 323134 - DNA, 582 bp, Homo sapiens
  misc_feature: GZ8MTXP02HUZ72.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaaacccacttattcttattggtaccagcagaagccaggccaggccctgtgttgtgatatataaagacactgagagccttcgaggactccctgagcgtattctctcggctcccacctcgagggaacaagtcggtacaactattcgaacctatacgagtggaacgtccgaaggcaaggaagtacgaggtctagacttatttcgtagttacaaattccttagaatactatcgaagttaggttaacttattgttacgttacggaacgtcgggaacctaaggtcctaaccgttactacgggtacaaccggacccgaaacggaccccaaacccgacttacgtacctacttccgttaccccg

SEQ ID NO: 323135 - DNA, 611 bp, Homo sapiens
  misc_feature: GZ8MTXP02I64ON.51.6.A06.1.454.CMB.2.raw
  modified_base (299)..(299): a, c, t, g, unknown or other
  misc_feature (299)..(299): n is a, c, g, or t
  modified_base (483)..(483): a, c, t, g, unknown or other
  misc_feature (483)..(483): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggacgtccctgagactctcctgtgaagcctctggattcagcttcagtacgtattggttgcgcgtgggtcccnccaggctccgaggcgaagggctgcgaggtgggtgcatctatatcattagtaggaaaggagacaaaattaaaacgtactaaccggacaaggtaacccttccggtagggaaacggggtacccgtaattcccaacctatcctacccgaagaacgaacaaactacccaaaagaccaactaacttttanacgtagaacaaaacgttcgaaacctacccgtaggacgtaccttaggacggaacgcggtccttagtacttaatttacgttaggttcgacgggaaggtacggggaagtacgttacggactacgaacgacg

SEQ ID NO: 323136 - DNA, 510 bp, Homo sapiens
  misc_feature: GZ8MTXP02JZUIF.51.6.A06.1.454.CMB.2.raw
  modified_base (455)..(455): a, c, t, g, unknown or other
  misc_feature (455)..(455): n is a, c, g, or t
  modified_base (472)..(472): a, c, t, g, unknown or other
  misc_feature (472)..(472): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagcactgagacggccttacgaggggtactcccgtgaacgcgtaactttctcgtggcccttaccacctcgagggacaagtggtacacattcgacatcagtggagtcaggcagaagacgagctgactattcngtacaattctcagactnacagtgtaacttatcgtctacggaactgggtaccaagg

SEQ ID NO: 323137 - DNA, 635 bp, Homo sapiens
  misc_feature: GZ8MTXP02HMLYA.51.6.A06.1.454.CMB.2.raw
  modified_base (309)..(309): a, c, t, g, unknown or other
  misc_feature (309)..(309): n is a, c, g, or t
  modified_base (395)..(395): a, c, t, g, unknown or other
  misc_feature (395)..(395): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtcctgagactctctgtgacgcctcgtggattcagtcttcgaggttacgtagttgggtttgccggtcgttcggggtcccnccgagggtcctccgaggtacgaaaggggctggcgagggttggggtcggctagttctaatacgtacagttaagtaggaaagggtaanacctaaaattaaaacgtacctaaccggcaaacggtaccgttacccggtaagggaaacgggcccgtaattcccaacctactcctaccgaagaacgaacaaactacccgaaaacaacctaactaacttttagactacgaactaaaactcgaaacctacccgtagaacgacgttaggaacgacacggtcttagtacttaattcgttgacgaggaaggagggtacgacgtacgactacgacgcg

SEQ ID NO: 323138 - DNA, 717 bp, Homo sapiens
  misc_feature: GZ8MTXP02FX7TR.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggacgtcctgacgctctcctgtgacgcctgtggattcagtcttacgagttacgtagttgggtttcgccgtgtcgggtcccgccgaggcctacgaggacgaaacgggtctggcgtagggttggggcgctatcgtattactcaagttagtagggaaaacggaatacctaaaataaaacgttaccgtaaccggactaaacggtaccgtacccgggtaaaggggaaacggggacccttaattacccgaacctaattacccgaacccgaaagggtaaccgtaaaacctaaaacccgtaacccccgaaaaaagtaaaacccctaaaccgtttaaacctttttaacgacctttaacggaaaaccctaaaaacggttacgaaaaccccctacccgtttaaggaacgtacgttagggaacggtaaaccgtacggtcttagttacttaagtttagtggacggagaagggtagggaatacggttacgaacgacgacgacg

SEQ ID NO: 323139 - DNA, 544 bp, Homo sapiens
  misc_feature: GZ8MTXP02FW4VR.51.6.A06.1.454.CMB.2.raw
  modified_base (437)..(437): a, c, t, g, unknown or other
  misc_feature (437)..(437): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgacccaacccactattcttattcggtaccagcagaagccaggccaggcccctgtgttgtgatatataaagacactgagaggcctttacgagggactcccgtagagcgtattctctcggcctccacctcgagggacaagtcggtcactattcgacctatcgagtgagtccgaggacagaagacgaggctagtacttattctagtactaattcttanagtacatcgagttgtacttatgttactacggaacgtcggaacaggtctaccgtcgtacggtaccacgacccgaacggacccaacccactacgtcctacctcttcccg

SEQ ID NO: 323140 - DNA, 496 bp, Homo sapiens
  misc_feature: GZ8MTXP02IH1EY.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccatattcttattggtaccagcagaagccaggccaggcccctgtgttgttgatatataaagcactgagaggccttagagggatcccgtgagcgattctctggcctccactcagggacaatggtcacattgaccatcagtggatccaggcagaagacgaggctgactattctgtcaatcttcagacatcagtggtacttatgtacttcggactggaacaggtcaacgtctaggtcacgccaaggcccaaacccgctacgtcactctcccg

SEQ ID NO: 323141 - DNA, 512 bp, Homo sapiens
  misc_feature: GZ8MTXP02JER6Q.51.6.A06.1.454.CMB.2.raw
  modified_base (294)..(294): a, c, t, g, unknown or other
  misc_feature (294)..(294): n is a, c, g, or t
  modified_base (348)..(348): a, c, t, g, unknown or other
  misc_feature (348)..(348): n is a, c, g, or t
  modified_base (392)..(392): a, c, t, g, unknown or other
  misc_feature (392)..(392): n is a, c, g, or t
  modified_base (424)..(424): a, c, t, g, unknown or other
  misc_feature (424)..(424): n is a, c, g, or t
  modified_base (476)..(476): a, c, t, g, unknown or other
  misc_feature (476)..(476): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgagcctctggattcagcttcagtacgtatggtttgcgctgggtccnccaggctccgaggcaagggctgcaggtgggtgcatctatatcatatgaaaggancaaataaatctacgcaagactcgtagaacggccattcaccatcnccaagagacaatcccaaagaacactactttancctagacaaatcgaaacaccctgagtactgacgacacggctagtactaattnttacgtgacgaaggaggganacncgactacgacacg

SEQ ID NO: 323142 - DNA, 626 bp, Homo sapiens
  misc_feature: GZ8MTXP02I3WNY.51.6.A06.1.454.CMB.2.raw
  modified_base (155)..(155): a, c, t, g, unknown or other
  misc_feature (155)..(155): n is a, c, g, or t
  modified_base (297)..(297): a, c, t, g, unknown or other
  misc_feature (297)..(297): n is a, c, g, or t
  modified_base (486)..(486): a, c, t, g, unknown or other
  misc_feature (486)..(486): n is a, c, g, or t
  modified_base (504)..(504): a, c, t, g, unknown or other
  misc_feature (504)..(504): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttccncgttgctcttttaagaggtgtccagtgtcaggtgcagctggtgcaggtcgtgggggaggcgtggtccagccgtgggagtccctgagactctctgtgagcctgtgattcagtcttcagtacgtagtggttgcgcgtgggtccncaggcctcgaggcgaagggactggcgaggtggggtgactattcgtaatactactataacgtaggaaaaggaacactaaaataaaacgtaccgtacggactaacggtacctacccgggtaaggaacggggtacccgtaattaccgaccctagttacccacccgaagaacgaaccaaacgtacccgaaaanacctaacttaacctttanaccgttagaacctaaagtacgaaaccctaccgtagacgtacgtaggaacggtacacggtcttagtacttagtttacgtacggtgaggaaggtacggggaatacgtacggaacacgaacgacg

SEQ ID NO: 323143 - DNA, 609 bp, Homo sapiens
  misc_feature: GZ8MTXP02I541U.51.6.A06.1.454.CMB.2.raw
  modified_base (262)..(262): a, c, t, g, unknown or other
  misc_feature (262)..(262): n is a, c, g, or t
  modified_base (308)..(308): a, c, t, g, unknown or other
  misc_feature (308)..(308): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccaggccgtgggacgtccctgacgtactctctgtgaagccctntggattcagtcttcagtacgttatggtttgccgtcgtcgggtcccnccgaggtcctccgaggcgaagggctgcaggtggtggcatctatntcatatgaaaggantaaataaatacctacgcagacctccgtagaacgggccattcgaccatccgtacccaaggaacaaccgtaacaccccgaaaagaaaccctaactaaccttttactacctagtaaacctaaacgtacgaaccctaacccgtagaacgtaacccgttaggaacggtaacctacgggtacttcggtaacttaagttacgtttaggcgtacggaaggtaggggatacgtacgactaccgaacgaccgg

SEQ ID NO: 323144 - DNA, 595 bp, Homo sapiens
  misc_feature: GZ8MTXP02FWRGQ.51.6.A06.1.454.CMB.2.raw
  modified_base (428)..(428): a, c, t, g, unknown or other
  misc_feature (428)..(428): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaacccacttattcttattggtaccagcagaagccaggccaggcccctgtgttgttgatatataaagacactgagaggccttcgagggactccctgagcgtattctctcggcctccacctcagggacaatggtcactattcgacatcagtgagtccgaggacaagaagacgaggctagacttattctagtcaaattcttanagacatcgtagtaggttactttatgtacgttacgggaacttacggggaaccgtaaagggtaccctaacccggttaccgttaacggggtaccaacggacccccgaaaacggggtacccccaaaacccccggtacttaccggttacccaaccgtttcctttaacccccg

SEQ ID NO: 323145 - DNA, 550 bp, Homo sapiens
  misc_feature: GZ8MTXP02FZNC9.51.6.A06.1.454.CMB.2.raw
  modified_base (415)..(415): a, c, t, g, unknown or other
  misc_feature (415)..(415): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggactccctgagcgattctctcgctccactcaggacaatggtcacattcgaccatcgagtggagtccaggacagaagacgaggctgactagttctgtacaatcttanagacatcgagttggtacttaagtgttcttacgggaaacgttcgggaacctaaggttccgaaccgttccgtacggttaccacgaccccaaacggaccccaaaccccgtacgtacgttaccaccgtactttaccccg

SEQ ID NO: 323146 - DNA, 616 bp, Homo sapiens
  misc_feature: GZ8MTXP02JXLE6.51.6.A06.1.454.CMB.2.raw
  modified_base (303)..(303): a, c, t, g, unknown or other
  misc_feature (303)..(303): n is a, c, g, or t
  modified_base (471)..(471): a, c, t, g, unknown or other
  misc_feature (471)..(471): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggagtccctgagactctcctgtgaagcctctggattcagtcttcagtacgtagttggtttgcgtcgtgggtcccnccgaggcctaccgaggcaaggggctggcgtaggtgggtgcatctaatatcatataggaaaaggaagcaaaattaaaactacctacgacaagacctcggtagaacggggacctattacaccagtccaccaaggaacaacaaacctacccaaaagaaccaactactttanacctagaacctaaataccgaaacctaaccccgtagaacgttacgttacggaacggtaccgtacggtacttacggttaaccttaagttttacgttgggtacggaacggtaagggaaggggagtacgtacggtactacgaacgaacg

SEQ ID NO: 323147 - DNA, 571 bp, Homo sapiens
  misc_feature: GZ8MTXP02FP35H.51.6.A06.1.454.CMB.2.raw
  modified_base (259)..(259): a, c, t, g, unknown or other
  misc_feature (259)..(259): n is a, c, g, or t
  modified_base (280)..(280): a, c, t, g, unknown or other
  misc_feature (280)..(280): n is a, c, g, or t
  modified_base (355)..(355): a, c, t, g, unknown or other
  misc_feature (355)..(355): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggttttcctcgttagctcttttaagaggtgtccagtgtcaggtgcagctggtgcagtcgtgggggagcgtggtccagccgtggggagtccctgagactctcctgtgagccctntggattcagcttcagtacgtnttggttgcgcgtgggtccgcaggctccgaggcaagggctgcaggtgggtgcatctatatcatagtagaaaggaanactaaataaactacgacgacagtaccgtcggtaggacggtacctataccactactcgaccagacaacaactaaccaaagaacctacttacttacacgtacgaactaaacgtacgaacctaccgtagacgtaacgtaggaacgtacgtacggtacttgttacttacttacgttacgtacgacggaaggaggtaacggacgtacgtacgacgacgacg

SEQ ID NO: 323148 - DNA, 639 bp, Homo sapiens
  misc_feature: GZ8MTXP02GXQNW.51.6.A06.1.454.CMB.2.raw
  modified_base (259)..(259): a, c, t, g, unknown or other
  misc_feature (259)..(259): n is a, c, g, or t
  modified_base (375)..(375): a, c, t, g, unknown or other
  misc_feature (375)..(375): n is a, c, g, or t
  modified_base (443)..(443): a, c, t, g, unknown or other
  misc_feature (443)..(443): n is a, c, g, or t
tcagcgatcgtatacacgaccggtgctcgatttagatctactgacaggggtctgggagacgagcccagcactggaagtcaccggtgtttccattcggtgatcatcactgaacacagaggactcaccatggagtttgggctgagctgggttttcctcgttgctcttttaagaggtgtccagtgtcaggtgtagctggtgcagtcgtgggggagcgtggtccagccgtggggaggtccctgagactctcctgtgacgcctntggattcagcttcagtacgttagtggtttcgcggtcgtcggggtccgccgagggcctccgaggcgaagggctggcgtaggtgggtcggctatctatactcatagtaggaaaggaanacaagtaaactactaacgacaacgtaccgtaccgggtagggaaacgggtccctaattacccaaccgtnttaccgtaccgaaggaacaaccaactaccccaaagtaaacctaccttaatttactcaacgtactaaaactacgaaacccaccgtaggaaacgtacgttaggacgggtaactacggggcttagtacttaagtttactagggtacgaggggtaggaaagggggtacaacgttacccgggattaccgacgaacgcccgg

SEQ ID NO: 323149 - DNA, 546 bp, Homo sapiens
  misc_feature: GZ8MTXP02H24MV.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttaattggtacccagcagaagccaggccaggcccctgtgttgtgatatataaagacactgagaggccttcgagggactcccgtgagcgattctctcggcctccacctcagggacaatggtcacattcgaccatcagtgagtccagcagaagacgaggctagactattctgtacaatcttcagacatcagtggttacttatcgttacgttacgaacgttcgggacctaaggtccctaaaccggtcctacgggtacctacggacccgaaacggccccaaaaccccgctaccgtcctaaccgtctttaccccg

SEQ ID NO: 323150 - DNA, 498 bp, Homo sapiens
  misc_feature: GZ8MTXP02INSNN.51.6.A06.1.454.CMB.2.raw
  modified_base (297)..(297): a, c, t, g, unknown or other
  misc_feature (297)..(297): n is a, c, g, or t
  modified_base (352)..(352): a, c, t, g, unknown or other
  misc_feature (352)..(352): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagccctctggattcagcttcagtacgtatggtttgcgcgtgggtccnccaggcctccaggccaagggctgcgaggtgggtgcatctatatcatatgaagganctaaataaatactagcagactcgagaggcatcacatcncananacanaccaanacactacttanctnacaatcgaacaccngaatactagacggacacggtctagtactattatgtgcggaagtaggacgatacgactcgacgacg

SEQ ID NO: 323151 - DNA, 654 bp, Homo sapiens
  misc_feature: GZ8MTXP02IT8JP.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggaggtccccgagactctcctgtgaagcctctggattcagcttcagtacgtatggtttgcgcgtcggggtcccgcagggcctccgaggaccgaaggggacctggcgaggtggggtggcagtctatactcatagtaggaaggaagacaataaactacgtaacgacctaaggaccgtccggtagaacgggggcctattacaaccatcctaccgaagaacgaaaccaaactaccccaaaagtaaaccctaaccttaacgtttaaactcctacgaacaaaacgttacgaaaccctacccgtagtaaacgtaccgttaaggaacggaccgtaaacgggtcttaggttacctttaaagttagtttccggtacggtacggtaaagggaagggggtaaccgtattacccggaattaccggaaccacggaacccg

SEQ ID NO: 323152 - DNA, 566 bp, Homo sapiens
  misc_feature: GZ8MTXP02JS84W.51.6.A06.1.454.CMB.2.raw
  modified_base (307)..(307): a, c, t, g, unknown or other
  misc_feature (307)..(307): n is a, c, g, or t
  modified_base (347)..(348): a, c, t, g, unknown or other
  misc_feature (347)..(348): n is a, c, g, or t
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
  modified_base (507)..(507): a, c, t, g, unknown or other
  misc_feature (507)..(507): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctggggttttcctcgttgctcttttaagaggtgtccagtgtcaggtgcagctggtgcaggtctggggggagcgtggtccagccgtgggacggtccctgacgctctcctgtgaacgcctgtggattcagcttcagttacgtagttggtttgcgtcgtgggtcccncgaggctccgaggcaagggctgcaggtgggtgcatctatnnatagtgaagganacaaataaatactacgnacgacgtccgtaggaaacggccgattaccacatcctaccaagagaaccaactacccaaagaaccaactaactttatctagaacaaatcgaaactacccgtagaacgtactaggaacgtacgaaccgggtntacgtacttagttacgtcgtacggaggaaggagggtaacacgtacgtactacgaacacg

SEQ ID NO: 323153 - DNA, 704 bp, Homo sapiens
  misc_feature: GZ8MTXP02GWRIQ.51.6.A06.1.454.CMB.2.raw
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtgggagtccctgagactctctgtgagcctntggattcagcttcagtacgtatggttgcgcgtgggtccncgaggctccgaggcaagggctgcgaggtggggtgcagttctaatactcaatagtaggaaagggaaacgactaaaattaaaacgtacctaacgacaacggtaaccgttacccgggttaagggaaaccggggacccggttaaactttaccccgaaaccctaacttacccgttaaccccgaaaggtaaaccggaaaccaaaaccgtaacccccaaaaaaggaaaccctaaaccttaacctttttaaacgtacccttaacggaaacctaaaaacgttaccggaaaaccctaaccccgtaaggtaacgtaaccgtttagggaaaccggtaaccgaaccgggtcttacggttacttacgtttagttacggtggtacggaaggtagggaacgtagtacggactaccgacgaaccgg

SEQ ID NO: 323154 - DNA, 558 bp, Homo sapiens
  misc_feature: GZ8MTXP02HKWKG.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagttacgtatggtttgcgtccgtggggtcccgccagggcctccgaggcaaggggctgcaggtgggtgcatctaatatcatataggaagaagcaaataaatactacgacagacctccgtagaacgggcccgattccacctatctaccaagacgaacaaactaccccaaagaaacctaactaacttttatactagacaaaactgaaaccacctagacgacttagacggtacacgggcttggtacttaagttacgttgtagaggaagagggagtactacgatacgaacgacg

SEQ ID NO: 323155 - DNA, 621 bp, Homo sapiens
  misc_feature: GZ8MTXP02FVS1Y.51.6.A06.1.454.CMB.2.raw
  modified_base (496)..(496): a, c, t, g, unknown or other
  misc_feature (496)..(496): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccaggccgtggggacggtccctgacgactctccgtgtagaacgcctcgtggtattcagtcttcagtacgtatggttgcgcgtgggtccgcgaggctccaggcgaagggctgcaggtgggtgcagtctatatcatatgaaaggagacaaataaatacgtacgactaagacgtaccgtagaaacgggccgtacttacaacctagttaccaccgaagacgaaccaaactacccaaaagaacccaaattaaccttaatctacaacaaaactcgaaaaccncccgtagacgtaacgtacggaacggaacaccggggtacttaccggttacttaaacgtttacgttaacggtggaccgggaaaggaacggggtaagtacgtacggtaactaccgaacgtaaacccgg

SEQ ID NO: 323156 - DNA, 633 bp, Homo sapiens
  misc_feature: GZ8MTXP02GNS9R.51.6.A06.1.454.CMB.2.raw
  modified_base (454)..(454): a, c, t, g, unknown or other
  misc_feature (454)..(454): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaacccacttattcttattggtaccagcagaagccaggccacggccctgtgttgtgatataataaagacactgagacggtccttgagggactcccgtggagcgtattcctcgtcggctaccctacgtcgaagggacaagtcggacacgtattcgaccatcgaggtcggagtccgaggacaaggaacgacggaggtctagtacttacgttctagtactaattccttanacgtaactacgtacgtaaggtttcggttaactttaagttcgtttacggttacgggtaaaccggttacggggtaacccgttaaacgggtccctacccggttacgttaacggggtaccaccggaaccccgaaacgacccccaaaccccgtacgttcgtaccctaccgttaccgtttccccg

SEQ ID NO: 323157 - DNA, 781 bp, Homo sapiens
  misc_feature: GZ8MTXP02IEZ5X.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgcattcgacccaaaccctattatttcttattcggtaccagcaagaagccaggccacggccctgtgttgtgatataataaagactacgtagagacggtcctttacgaacgggtactcccgtagacggtacgtactttcctcgttcccggacccttaccccgaccttacggaacggggtaactaaacggttccgggttaacctaaacctacgtttaccgaaccctacgtacgtaaggggtacgggtaacgtacccggaaagggtaccgaaagggaaaacggaaccggggtaacggggtaccttaacgggtaaccttttacgtttttaccgtaacggtttaaccttaaaaccgtttaccttttaaccgaaacggtaacctaacgtttaccgtaagggtttacggtttaactttacgttacgtttaccggttaacgggtaaaccggttacggggaaaacccgttaacgggtacccttaacccggttaccgttaacgggacctaaccggaaccccggaaaccggtaccccaaaccccgtcgtaccgtaccacctttaccgttcccccg

SEQ ID NO: 323158 - DNA, 731 bp, Homo sapiens
  misc_feature: GZ8MTXP02F374C.51.6.A06.1.454.CMB.2.raw
  modified_base (336)..(336): a, c, t, g, unknown or other
  misc_feature (336)..(336): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagcgtgggacgtccgtgacgctctcgtgtacgacgccttgtggtatcagtcttagagttacgtagttggttgccgtcgtcgggtcccgcgtagcctacgaggacggaacgggtcnggcgagggtcggtggactagtactaatacgtactagtaagtaaggaaaaggaaactactaaaacttaaaacgtaccgttaacgaccgtaaacggtaccgtacccgggtaaaggggaaacccgggaccctttaaacgttaccccgaaaccttacggtttaccccaaccggtaaacgggtaaaccaaacctaaaacccgtaaccccgaaaaacgtaaacccttaactttaaaccgtttttaaccgacttaaaaccggaaaacctaaaacgttacccggaaaacctcccgttaaaggacgtaacgttacggaaccggaaccgtacgtccgtttataaactttacgttgtacggagaacggtaaggacggtaagtacgacgtactacccgaagtaaccg

SEQ ID NO: 323159 - DNA, 582 bp, Homo sapiens
  misc_feature: GZ8MTXP02IYDBP.51.6.A06.1.454.CMB.2.raw
  modified_base (297)..(297): a, c, t, g, unknown or other
  misc_feature (297)..(297): n is a, c, g, or t
  modified_base (354)..(354): a, c, t, g, unknown or other
  misc_feature (354)..(354): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctggggaggtccctgagactctcctgtgaagcctctggattcagcttcagtacgtatggttgccgcgtgggtccncgaggctccgaggcaagggctgcaggtgggtgcagtctatatcatagtagaaggaancaaataaatacgtacgacagacctccgtagaacgggcctattcaaccatctccgaagacgacaaacgtcccaaagaaaccactaactttatactagaccaaaatcgaaacctacccgtagacgtacgttagacgtaaccgaacggtcttacggttacttacgtttacgttaggttcggaacggaagggtaacggggtaagacgttacggaacttaccgaacgtaacgg

SEQ ID NO: 323160 - DNA, 571 bp, Homo sapiens
  misc_feature: GZ8MTXP02F0XU0.51.6.A06.1.454.CMB.2.raw
  modified_base (297)..(297): a, c, t, g, unknown or other
  misc_feature (297)..(297): n is a, c, g, or t
  modified_base (365)..(365): a, c, t, g, unknown or other
  misc_feature (365)..(365): n is a, c, g, or t
  modified_base (417)..(417): a, c, t, g, unknown or other
  misc_feature (417)..(417): n is a, c, g, or t
  modified_base (458)..(458): a, c, t, g, unknown or other
  misc_feature (458)..(458): n is a, c, g, or t
  modified_base (513)..(513): a, c, t, g, unknown or other
  misc_feature (513)..(513): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtctgggggagcgtggtccagcctgggagtccctgagactctcctgtgaagcctctggattcagcttcagtacgtatggtttgcgtctgggtcccnccaggcctccgaggccgaaaggggctgcgaggtggggtgcagtctatatcaatagtaggaaagggaanacaaaataaactactaacgcaagacctccggtagaacgggcctattccaacntacctccaagacgacaaactcccaaagaaccactactttanctagaactaaactcgaaaccacccgtagacgtaacctggaacgaccgtaccggtnttacgttacttagttacgtacgaggacgaaggtaggacgtacgtacgacacgacgacg

SEQ ID NO: 323161 - DNA, 796 bp, Homo sapiens
  misc_feature: GZ8MTXP02HSID6.51.6.A06.1.454.CMB.2.raw
  modified_base (496)..(496): a, c, t, g, unknown or other
  misc_feature (496)..(496): n is a, c, g, or t
  modified_base (788)..(796): a, c, t, g, unknown or other
  misc_feature (788)..(796): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagccacctggtgtccgtgtcccacgagacgacggccgacgagtcacctcgtctcgtggaggatgcatacgtacccaaccccaacttatttacttacttacggttaccgaacgacgaagaaagacccgacggaccgaccggtaccccgtcgttaggtttggttgtaaagttaaataaagttaaaacgaaaccgtaaccgtaggtaaggaacggtaccggttaccgtaacggggtacgttacccccgttaggaacggtccgttaaacgtttctttaccgtccggggtacccgttaaacccccnccccgttaaaccgtaaacggggggaaaccctaaaaagttcggggttaccccgaaaactaaccggtttttaaacggaacccccgaaattttaccccggaaacggggtttaaggggttaaccccgggtaacccgaacgggggtaaacccgaaaaacggggtaaaaaagggggtaacccccgggaaaagggggtccgtttaaaaacccgggtaaccgttttttaaaaccgttttttcccccggtttaaacgggttaaccccgtaaaaaaaccgtttttacccgttttaacccggnnnnnnnnn

SEQ ID NO: 323162 - DNA, 511 bp, Homo sapiens
  misc_feature: GZ8MTXP02G24D0.51.6.A06.1.454.CMB.2.raw
  modified_base (409)..(409): a, c, t, g, unknown or other
  misc_feature (409)..(409): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgtgatatataaagacactgagaggccttcagggatccctgagcgattctctcggctccactcagggaccaatggtcacattgaccatcagtgagtccagcagaagacgaggctgactagttctgtcaatcttnagacatcagtggtacttatgttcttcggaacttcgggaaccaaggtcaaccgtcgtacggtcacgcccaaggcccaaccccgctacgtacacctcgttcccg

SEQ ID NO: 323163 - DNA, 605 bp, Homo sapiens
  misc_feature: GZ8MTXP02JSTR0.51.6.A06.1.454.CMB.2.raw
  modified_base (296)..(296): a, c, t, g, unknown or other
  misc_feature (296)..(296): n is a, c, g, or t
  modified_base (367)..(367): a, c, t, g, unknown or other
  misc_feature (367)..(367): n is a, c, g, or t
  modified_base (433)..(433): a, c, t, g, unknown or other
  misc_feature (433)..(433): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaacgcctctggattcagcttcagtacgtatggttgcgcgtgggtccnccgaggctcaggcaagggactggcaggtgggtgcatctatatcatatgaagaagcaaataaatactacganagactccggtagacgggccgattcaccatctaccagagacaactacccaaagaccaactactttanactacgactaaagtacgaaacctacccgtagaacgttaacgttacggaacgggtaaacctacggggtaccttacgggttacccttaaagttttaaccgttggggttaccggtacgggtaaacgggaacgggggtaaacggtaacgttacggacttaaccgaacgaaaccggg

SEQ ID NO: 323164 - DNA, 637 bp, Homo sapiens
  misc_feature: GZ8MTXP02HLIRA.51.6.A06.1.454.CMB.2.raw
  modified_base (258)..(258): a, c, t, g, unknown or other
  misc_feature (258)..(258): n is a, c, g, or t
  modified_base (305)..(305): a, c, t, g, unknown or other
  misc_feature (305)..(305): n is a, c, g, or t
  modified_base (379)..(379): a, c, t, g, unknown or other
  misc_feature (379)..(379): n is a, c, g, or t
  modified_base (510)..(510): a, c, t, g, unknown or other
  misc_feature (510)..(510): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtggtccagccgtgggagtccctgagctctcctgtgacgcctntggattcagtcttacagttacgtagttggttgcgtcgtcgggtcccncgaggcctccgaggcgaagggctggcgaggtggggtgactagttactaatatactataagtacggaaaaggaanacctaaaattaaaacgtactaaccgacgtaacgaccgtcggtaaggaacggggtaccctaattaccaaccctacttacctacccgaaggaacaactaaaccaacccaaaagaaacctaactacttttaacncgttaacgaactaaaatcgaaaccctaccgtagacgtactaggaacgtaccgacgtacgtagtacgttagtttacgtacggtcgacggaagggaagggtacgtacgtacggtaactaccgaacgacg

SEQ ID NO: 323165 - DNA, 621 bp, Homo sapiens
  misc_feature: GZ8MTXP02GBB5M.51.6.A06.1.454.CMB.2.raw
  modified_base (254)..(254): a, c, t, g, unknown or other
  misc_feature (254)..(254): n is a, c, g, or t
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
  modified_base (366)..(366): a, c, t, g, unknown or other
  misc_feature (366)..(366): n is a, c, g, or t
  modified_base (482)..(482): a, c, t, g, unknown or other
  misc_feature (482)..(482): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgacgactctctgtgagcctntggattcagtcttcgagttacgtagttggtttgccgtctggggtcccnccgaggcctcgaggcaaaggggctggcaggtgggngcatctatagtcaatagtaggaaaggaancgtaaataaaactacgtacgacaagtacctaccggtagaaacgggtcccgaatttccaaccgtataccgtacccaaggaacgaaccaactacccaaagaaaccactaacttttacncctaggaacctaaaacgtcgaaaaccctacccgtagaacgtaccgttaggacgaaacgaccggggttacttacgttacttaagtttacgtacggtacgacggaagggtaacggtaacgtacgtacgactacgaacgacg

SEQ ID NO: 323166 - DNA, 630 bp, Homo sapiens
  misc_feature: GZ8MTXP02GGR67.51.6.A06.1.454.CMB.2.raw
  modified_base (314)..(314): a, c, t, g, unknown or other
  misc_feature (314)..(314): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtggggggaggcgtggtccaggccgtggggacggtccctgagactctcctgtgaacgccctcgtggattcagtcttacgagtacgtagtgggtttgcgtcgtgggtcccnccgaggcctcgaggcgaagggctgcaggtgggtgacatctatatcatataggaaacggaagcaaaataaaactacgtacgacaacgaccgtaccggtagaacgggtaccgaattaccacctattccaccgaagaacgaaccaaactacccaaaagaaacctaacctaactttacactacgaactaaaacgtacgaaaccctaccctaggaacgtacgttacggaacggtaaccgacggtacctttggttaaccttaagtttaacgtcggtacgacgggaaggtaaggggatacgtacgaaacgtccgaacaaccgg

SEQ ID NO: 323167 - DNA, 636 bp, Homo sapiens
  misc_feature: GZ8MTXP02J3Z21.51.6.A06.1.454.CMB.2.raw
  modified_base (478)..(478): a, c, t, g, unknown or other
  misc_feature (478)..(478): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggccctcctatgtgctgacacagccaccctcggtgtcccgtgtccccaggacagacggccaggatcacctgctctggagatgctattcgacccaacccctacttatttcttaattggacccagcagaagcccaggccaggtccccttttgttgtgatataataaagcacgtgaggacggccttcgaaggactccctggaggcgatttctctcggccctcccacctcaaggggtacaaagttcgggtctactaacttcggaccaattcgaggtgggacgtccgagggaccaggaacgacgtaaggcttagaactttatttacgttgtactaattaccttanacgtacatcaggttaggttaacttgttacgttcgtttacgggtaacgtaacgggtaccgtaagggtacctacccggtaccgtacggttaccgaaccgacccgacggaaccccaaccccctaccttacgtacctacctttccttcccgtttaccccccc

SEQ ID NO: 323168 - DNA, 629 bp, Homo sapiens
  misc_feature: GZ8MTXP02FJA0V.51.6.A06.1.454.CMB.2.raw
  modified_base (263)..(263): a, c, t, g, unknown or other
  misc_feature (263)..(263): n is a, c, g, or t
  modified_base (305)..(305): a, c, t, g, unknown or other
  misc_feature (305)..(305): n is a, c, g, or t
  modified_base (374)..(374): a, c, t, g, unknown or other
  misc_feature (374)..(374): n is a, c, g, or t
  modified_base (488)..(488): a, c, t, g, unknown or other
  misc_feature (488)..(488): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtggggggaggcgtggtccaggccgtggggacggtccctgagctctcctgtgagccctntggattcagcttcagtacgtatggtttgcgtcgtgggtcccncgaggcctccgaggcaaggggactggcagggtgggtgcattctaatatcaataagtaggaaaagggaanacaaaataaaactacgtaaccgacaagtacctccggtagaaacggggcccgtattaccaccatccctaccaagaacgaaccaaacgtacccaaaagaaaccaaactactttaanactagaacaaaactacgaaaccctacccgttagaacgtaacgttaggaaacggtaaccgacgggtccttagttacttaatttacgtttaggacggtaacggaagggaagggtaagtacgtcggtaaactccggaacaacgg

SEQ ID NO: 323169 - DNA, 626 bp, Homo sapiens
  misc_feature: GZ8MTXP02GEELD.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgacccaacccattattcttattggtaccagcagaagccaggccaggccctgtgttgtgatatataaagacactgagaggccttagagggtactcctgagcgtattctctacggctccactcagggacaatggtaccaacgtattacgaccatcgagttaggacgtacccgaggaccgaagtaaacggacgacgggacttaggtaactattttccgagttacctaaacttcttacaaggtacctagtaccgtaagtttacggttaactttaagttcgtttacgtttacgggaaaccgttacggggtaaaccctaaagggttccctaaccccggttacgtacgggtaccgacgaccccgaacggaccccaacccccgtaagtccgttacaaccttccgttaccccg

SEQ ID NO: 323170 - DNA, 648 bp, Homo sapiens
  misc_feature: GZ8MTXP02F8BMH.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgaccaacccattattcttattggtaccagcagaagccaggccaggcccctgtgttgtgatatataaagacactgagaggcttcgaggatccctgagtcgattctcgtcggcctcccacctcgaacggggaaccaagtcgggtaccaaactatttacgaaccctaagtccaagggtaggacgttacccagggaccaagaaacggacgaggggtactaggtaacttaacgtttctagttacctaaattcctttacagaactatacgtagttaggttaacttagttcgtacgttacggtaaacgtcggggtaacccaaacggttccgaaacccggtttacgtaacggttaccaaccggttaaccccaaaaccgggacccccaaaacccccggtactaccggtttaccaaccctttcgtttacccccgg

SEQ ID NO: 323171 - DNA, 558 bp, Homo sapiens
  misc_feature: GZ8MTXP02ISGMG.51.6.A06.1.454.CMB.2.raw
  modified_base (171)..(171): a, c, t, g, unknown or other
  misc_feature (171)..(171): n is a, c, g, or t
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (427)..(427): a, c, t, g, unknown or other
  misc_feature (427)..(427): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagnggtgtccagtgtcaggtgcagctggtgcaggtcgtgggggagcgtggtccaggcctgggagtccctgagactctcctgtgagcctctggattcagcttcagtacgtattggtttgcgtcgtgggtccnctaggctccgaggcaagggctgcaggtgggtgcatctatntcatatgaagancaaataaatacacgcagactcgtagacggcatcacatctccagacgacaactcccaaagaacctacgtacttttanacctagaaacctaaacgtacgaaacctacccgtaggaacgtacgttacggacggtaaccacgggtacttcgttacgtatttacgttggtacgtacggaaggtagggacgtacgtacgacgtacacgtaccg

SEQ ID NO: 323172 - DNA, 570 bp, Homo sapiens
  misc_feature: GZ8MTXP02IHDHG.51.6.A06.1.454.CMB.2.raw
  modified_base (300)..(300): a, c, t, g, unknown or other
  misc_feature (300)..(300): n is a, c, g, or t
  modified_base (355)..(355): a, c, t, g, unknown or other
  misc_feature (355)..(355): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggaggtccctgagactctcctgtgaagcctctggattcagcttcagtacgtatggtttgcgcgtggggtcccncgaggcctccgaggcaagggctgcagtgggtgcatctatatcatatgaaaggaancaaataaatactacgcagactccgtagaacggccgatcacatcacagacgacaacnccaaagaacactactttanctagacaaatacgaaacctacccgtagaacgtaccgttaggaacggtaccgtaacgggtctacggttaccttaagtttacgttacggttaggacggtaaggaacgggggaacgtagtacggtaactaccgaacgaaccgg

SEQ ID NO: 323173 - DNA, 545 bp, Homo sapiens
  misc_feature: GZ8MTXP02JUDDI.51.6.A06.1.454.CMB.2.raw
  modified_base (302)..(302): a, c, t, g, unknown or other
  misc_feature (302)..(302): n is a, c, g, or t
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgtagctctttaagaggtgtccagtgtcaggtgcagctggtgcagtcgtgggggaggcgtgggtccagcctggggaggtccctgagactctccgtgtgaagcctctggattcagcttcagtacgtatggtttgcgcgtggggtccnccgagggcctccgaggcgaaggggctgcgaggtggggtggcatctatatnattagagaaagggaanacaaataaaatacctacggnagacctcgtagaacggtccgattcactatacncagagacaactcccaaaanactactacttatctacactaacacgacaccgtagatacgtagacgaccgagtctacgtacttattacgtcgtagtaggaaggaggacgacgacgactacgacgacg

SEQ ID NO: 323174 - DNA, 636 bp, Homo sapiens
  misc_feature: GZ8MTXP02G00J2.51.6.A06.1.454.CMB.2.raw
  modified_base (215)..(215): a, c, t, g, unknown or other
  misc_feature (215)..(215): n is a, c, g, or t
  modified_base (448)..(448): a, c, t, g, unknown or other
  misc_feature (448)..(448): n is a, c, g, or t
  modified_base (490)..(490): a, c, t, g, unknown or other
  misc_feature (490)..(490): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctggtgtccgtgtccccaggacagacggccaggatcacctgctctgganatgctattcgacccaacccacttactttcttattcggtaacccagacagaaacgccacggccacggtccctgtcgttgttgataataataaagacacgtgagacggtccttcgaggctccctgacgcgtattcgtctcgcctcccactacgacgggtacaacgtggtaccaactacgttacgaaccctagtccgtagggtgacgttacccgagggacgaaaggaacggaacgngggactacggtattaacgtttcgtagtacctaagttccttanaacgtatacgttacgtaggttacgttaacttagttcggttacgtttaacgggaacgttacgggaccgtaacggtccctaccggtacgttaccggactaccgacccgaacgacccaacccgtacgtctacctaccgtcgtttccccg

SEQ ID NO: 323175 - DNA, 623 bp, Homo sapiens
  misc_feature: GZ8MTXP02HFNVR.51.6.A06.1.454.CMB.2.raw
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
  modified_base (332)..(332): a, c, t, g, unknown or other
  misc_feature (332)..(332): n is a, c, g, or t
  modified_base (505)..(505): a, c, t, g, unknown or other
  misc_feature (505)..(505): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagacctctcctgtgagcctctggattcagtcttcagtacgtatggttncgtcgtgggtccnccgaggcctccgaggcaagggctgcgaggttgggngctagtctatactcaatataggaaaggaagactaaaagttaaaactacctaaacggactaacggaacccgttcccgggtaggaaacggggtccccgtaattacccaaccctacttacccacccaaaggaaccgaaacaaacctaccccaaaagaaacctaacctacttttaanaccttacggaacctaaaagtacgaaaccctacccgttaggaaacgtacttacggaacggtaccacgggtctcgtactatttacgtgtcgaggaagaggacgtatacgactacgacacg

SEQ ID NO: 323176 - DNA, 585 bp, Homo sapiens
  misc_feature: GZ8MTXP02JKZ84.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgcattcgcccaacccactattcttattggtaccagcagagcaggccaggcccctgtgttgtgatatataaagacactgagacggtccttacgagggtctcccgtgacgcgtattctcgtcggtccctccctaccgtacgaaggggtaacctaagttcggtaccaactaacgtttacgaaccctattaccgaggttacgggaacgttacccgaggaccgaaaggaaacgacggaggtctaggtacttaagtttctcgtactaacttcttacagtacctataccgagttagtaacttagtcgttacgtacgaacgtacggtaacgtaacgg

SEQ ID NO: 323177 - DNA, 536 bp, Homo sapiens
  misc_feature: GZ8MTXP02JA2TW.51.6.A06.1.454.CMB.2.raw
  modified_base (252)..(252): a, c, t, g, unknown or other
  misc_feature (252)..(252): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
  modified_base (419)..(419): a, c, t, g, unknown or other
  misc_feature (419)..(419): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagctctctgtgagcctntggattcagtcttcagtacgtatggttncgtctgggtccncgaggctccgaggcaagggctgcaggtgggngcatctatatcatatgaaaggancaaataaactctacgnagactcgagacgggcatcacatctaccagacacatcccaaagaaccacgtactttancttagaactaaactacgaaacctacccgtaggaacgtacttgaacggtacacgggtctcggttactagtttactcggtagacggaaggtaggggtaacactacgactaccgaacgcg

SEQ ID NO: 323178 - DNA, 655 bp, Homo sapiens
  misc_feature: GZ8MTXP02GKIGG.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgccaaacccattattcttattggtaccagcagaagccaggccaggcccctgtgttgttgatataataaagacactgagaggccttcgagggactccctgagcgattctctcgcctccactcgaggacaatcggtcaactattacgactagtcaggtaggacgtacccgagggacaaggaaacgaacggagggtctacggtaaactttacttttacgtgttaacctaaatttcccgtttagaacggaacttaactccgtaaggttggtttaaacctttagtcgtttacgttacggggtaaacgtcggggtaaacccgtaagggttaccctaacccggttacccgttaacggggaccctaaccggacccccggtaaaaccggtacccccgaaaacccccttacggttccgtaaccacccgtttactttcccccg

SEQ ID NO: 323179 - DNA, 590 bp, Homo sapiens
  misc_feature: GZ8MTXP02IIM6A.51.6.A06.1.454.CMB.2.raw
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtgcagtcgtgggggagcgtggtccagccgtgggagtccctgagactctctgtagagcctnggattcagcttcgagtacgtagtggtttgcgcgtgggtcccncgaggcctccgaggcgaaagggctgcgtaggtgggtgctatctatatcatagagaaagganactaaataaatactacgacagtaccgtcgtagacggcctatcacatccacagacaacaactacccgaaaagacctaaactactttaacncgtanaactaaacgtacgtaaacccacgttagaacgtaaccgttaggggaacgaccgtaacgggtaccttggttaacttagtttacggttagacggacggaaggtaacgggtaagtacgtaccggtaacacgaacgtacgg

SEQ ID NO: 323180 - DNA, 650 bp, Homo sapiens
  misc_feature: GZ8MTXP02ICYRC.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttggctgagctgggttttcctcgttgcttcttttaagaggtgtccagtgtcagggtgcagctggtgcaggtcgtggggggagcgtggtccaggccgtggggacgtccctgacgtactctcctgtgacgccctgtggattcagtcttcagtacgtatggttgcgtcgtgggtcccgcgaggcctcgaggcgaaggggtctggcagggtgggtgactattctaatatactagtagtaggaaaggaatactaaaagtaaactaccgtaacgacaacgaccgttcgaggaacgggtacccgtacttacccacctatcccgtaccgaagaacgaacctaaacctacccaaaacgaaacctaaccttaactttactactacgaacctaaaactacgaaaccctaacccgtaggtaaccgtaacgttacggaaacggtaccgtacggtaccttagttaccttaaacgtttacgtaggtcggaagggtaaggaacgggaagtacgtacgtaactaccgaacgacg

SEQ ID NO: 323181 - DNA, 654 bp, Homo sapiens
  misc_feature: GZ8MTXP02FFRCZ.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctggtgtccgtgtccccaggacagacggccagatcacctgctctggagatgcattgccaacccattattcttatggtaccagcagaagccaggccaggcccctgtgttgttgatatataaagacactgagaggccttgagggactccctgacgcgattctcgcggcctccactcgagggacaagtgtcaactattacgaccatccaggttcgagtacccgagggacaggaaagacgaggtctagtacttaacgtttctagtactaaacttccttacgacgtaactaagttccgtaaggtttcgggttaacctttagtacggttaccgtttaccgggaaacgtacggggtaaacccgtaacgggttacccgtaacccggtttaccgtaaaccgggttacccgaacccggtacccccgaaaaccggggtacccccaaaaaccccccggtacgtttcccgtacccgtaaaccctttccgttttaccccccg

SEQ ID NO: 323182 - DNA, 565 bp, Homo sapiens
  misc_feature: GZ8MTXP02IM7NS.51.6.A06.1.454.CMB.2.raw
  modified_base (347)..(347): a, c, t, g, unknown or other
  misc_feature (347)..(347): n is a, c, g, or t
  modified_base (398)..(398): a, c, t, g, unknown or other
  misc_feature (398)..(398): n is a, c, g, or t
  modified_base (428)..(428): a, c, t, g, unknown or other
  misc_feature (428)..(428): n is a, c, g, or t
  modified_base (541)..(541): a, c, t, g, unknown or other
  misc_feature (541)..(541): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctctatgtgctgacacagccaccctggtgtccgtgtccccaggacagacggccaggatcacctgctcgtggagatgctattcgacccaaccctattatttcttattcggtaaccagcagaagccaggccaggccctgtgttgtgatatataagacactgagagcttgaggtactcccgtgagtcgtattctctcggcctccacctnacgggacaagtggtcacattcgaccatcgagtgatccgagcaagaagacgnggactgactattctagtactaaattcttanagactaactcgtagtggttaaccttagtcgttacgttacgaacgttacgggacctaaagggtccaaaccggttctacgggtaccacgaacccgaaacggtaccccaaaacccncgttacgacctacctacttccccg

SEQ ID NO: 323183 - DNA, 583 bp, Homo sapiens
  misc_feature: GZ8MTXP02JOQ4A.51.6.A06.1.454.CMB.2.raw
  modified_base (257)..(257): a, c, t, g, unknown or other
  misc_feature (257)..(257): n is a, c, g, or t
  modified_base (298)..(298): a, c, t, g, unknown or other
  misc_feature (298)..(298): n is a, c, g, or t
  modified_base (478)..(478): a, c, t, g, unknown or other
  misc_feature (478)..(478): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggagtccctgagactctcctgtgaagcctntggattcagtcttcagtacgtatggttgcgcgtgggtcccncgaggcctccgaggcaaggggctgcgaggtgggtgctagtctatatcaatagtaggaaaggaagcaaaattaaaataccgtaacgacaaggaccttcccgggtagaaacgggcccgtaattacccaacctactcctaccgaaggaacgaacaaactacccaaagaacctaactactttanctagaacaaagtcgaaaccaccgtagacgtacgtagaacggtacacggtctacgtacttaattacgtcgtgacggaaggtagggagtactcgactcgaacgtacg

SEQ ID NO: 323184 - DNA, 726 bp, Homo sapiens
  misc_feature: GZ8MTXP02HGHOX.51.6.A06.1.454.CMB.2.raw
  modified_base (215)..(215): a, c, t, g, unknown or other
  misc_feature (215)..(215): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattcgacccaaaccctattatttcttagttcggtaccagcaagaacgccaggccacggcccctgtcgttgtgatataataaagacactagagaggccttacgaggtactccgtgagcgtattctcgtcggcctccacctcgaggtaccaaagtcggtacaacgtactttacgaacctatacgtaggttacggacgtccgaacggacgaaaggaaaacgacggaaggtcgtaacggtaacttacgttttacgtagttacctaaagtttccctttaagaacggtaacctaagttacgtaaggttacggtttaaaccgtttaagttcggtttaccgtttaacgggtaaaaccggttacggggtaaaacccgttaaacggggtaccccgtaacccggtttaacccggtaacggggttaccccgaaacccggtaaaccccggtaaacccgggtacccccgaaaaacccccttacgtaccggtacccctaaccgtttacccgtttccccccgg

SEQ ID NO: 323185 - DNA, 626 bp, Homo sapiens
  misc_feature: GZ8MTXP02F5D4O.51.6.A06.1.454.CMB.2.raw
  modified_base (608)..(608): a, c, t, g, unknown or other
  misc_feature (608)..(608): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgctattcgacccaacccatatttcttaattcggtaccagcagagccaggccaggccctgtgttgtgatataataaacgacactgagacggaccttacgagggactcccgtggacgtcgtattctcgtccggtcctcccactacgagggacctaagtcggtacacgtattacgaaccctagtaccgaggttcggagtacccgaagggacaaaggaacggacggacgggtacttacggtaaccttaattttcgtacgttaactaaacgtttcctttacggaagtaacccttagtacccgttaaggttaggttacctttaagttcgttacgttacggtaacgtacggtacgaagtccgtaccgtacgtcgtacacgtaccgaacgacccaaccnctcgactactcgttcccg

SEQ ID NO: 323186 - DNA, 628 bp, Homo sapiens
  misc_feature: GZ8MTXP02GP7UO.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggttgcgtctgggtccgccaggctccgaggcaagggctgcgaggtgggtggcagtcatatcaatagtagaaaggagcaaataaaagtactacgcaagtacctacccggtagaaacggggccctaagttcaacccgtatcctacccgaagaacgaacctaaactaccccgaaaagaaacctaaacttaccttttaatacttacgaacctaaaagttacgaaaacccacccttaggaacgtaaccgtttgggaaacggtaacaaccgggtcttacggttaaccttaagtttaacgtggttcgaacgggtaaggaacgggggaagtacgtaccggtaataccgaacgaacggg

SEQ ID NO: 323187 - DNA, 537 bp, Homo sapiens
  misc_feature: GZ8MTXP02IAUDX.51.6.A06.1.454.CMB.2.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagaggccttcgagggatcccgtgagcgattctctcggcctccacctcgagggacaatggtacacattcgaccatcagtgatccaggcagagacgaggctgactatttctgtactaaatcttcaagacatcagtgtacttatgtacttacggaacgttcgggacctaaaggtccaaacccgttccgtacgggtaccacggacccaaaggaccccaaacccgtactacgtcctaactcttcccgg

SEQ ID NO: 323188 - DNA, 637 bp, Homo sapiens
  misc_feature: GZ8MTXP02F1FMM.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgcattcgacccaacccacttattcttattcggtaccagcagaagccaggccaggccctgtgttgtgatatataaagacactgagaggcctttacgagggtactcccgtggacgcgtattcgtcgtcggcctcccacctcgacgggactaagtggtacactattacgacctatacgagtggacgtccgaggacgaagaaacgacggacggtactagtacttatttctacgtactaaacttcttacgaacgtaacctataccgtaaggtttacggttaacctttagttcggttaccgtttaccgggaaacggttacggggtaaacccgtaagggttacccgtaccggttaccgtacggttaccgaccggaacccgaaacggtccccaaacccgtacgtcgtacctaccttcgtttaccccg

SEQ ID NO: 323189 - DNA, 638 bp, Homo sapiens
  misc_feature: GZ8MTXP02I3UJD.51.6.A06.1.454.CMB.2.raw
  modified_base (220)..(220): a, c, t, g, unknown or other
  misc_feature (220)..(220): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtcgtccccaggacagacggccaggatcacctgctctgganatgcattcgacccaaaccctatatttcttattcggtaccagcaagaacgccacggccacggtccccgtgtcgttgtagataataataaagacactgagacggtccttacgaggtactcccgtagagcgtattcctcgtcgtcctaccactcgagggactaagtcggtacactattacgactagtcaggtgacgtacgaaggacaaaggaacgacgaggtaccgtagtaactttacgtttacgtacgttaactaatttaccttacgaacgtactaacgttacgtacgtttaggttaacctttagttacgttaccgttacggtaacgtacggtaaaccgtaaggtacccgtaccgttaccgtacggtaccgaaccgtacccgaaacggtacccccaaacccgtacttacgaccttacccg

SEQ ID NO: 323190 - DNA, 603 bp, Homo sapiens
  misc_feature: GZ8MTXP02FHDY9.51.6.A06.1.454.CMB.2.raw
  modified_base (300)..(300): a, c, t, g, unknown or other
  misc_feature (300)..(300): n is a, c, g, or t
  modified_base (470)..(470): a, c, t, g, unknown or other
  misc_feature (470)..(470): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagcctgggaggtccctgagactctcctgtgaagcctctggattcagcttcagtacgtatggtttgcgcgtcgggtcccncaggctccgaggcaaggggctggcaggtgggtgctagttctaatatacaatagtaggaaaggaagacaaagtaaaactacgtaacgacaagacctaccggtagaacgggcccgtattaccaccaagttccaccgaagacgacaaactacccaaagaaccactaactttanacctagaactaaactacgaaaccaccctaggaacgtacgttaggaacggaaccgtacggtacttacggttacttaagtttacgtttcggagtacgggaaggaacggggaagtacgttacggaactcaacgacg

SEQ ID NO: 323191 - DNA, 650 bp, Homo sapiens
  misc_feature: GZ8MTXP02FXRRJ.51.6.A06.1.454.CMB.2.raw
  modified_base (258)..(258): a, c, t, g, unknown or other
  misc_feature (258)..(258): n is a, c, g, or t
  modified_base (380)..(380): a, c, t, g, unknown or other
  misc_feature (380)..(380): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggacgtccctgagactctctgtgagccctntggacttcgagcttcgagtacgtagttggtttgcgtcgtcgggtcccgcgaggcctccggaggcgaaggggcctggcgtagggtgggtcgctaattctaatatcaatagtaggaaaaggaanactaaaataaactaccgtacgacaacggtaccgttaccggtagggaaacggggccctaattaccaaccctaattaccaccgaagaacgaacaaacctacccgaaaagaaacctaacctacttatactagaactaaacgtacgtaaaccaccgttagaacgtaacgttacggaacggtaaccgacggtaccgttaggttaaccttagtttaacgttcggtaggaacggtaagggtaagggaacgtaacgtccggaattaccgaacgaaccg

SEQ ID NO: 323192 - DNA, 625 bp, Homo sapiens
  misc_feature: GZ8MTXP02GMEYR.51.6.A06.1.454.CMB.2.raw
  modified_base (303)..(303): a, c, t, g, unknown or other
  misc_feature (303)..(303): n is a, c, g, or t
  modified_base (369)..(369): a, c, t, g, unknown or other
  misc_feature (369)..(369): n is a, c, g, or t
  modified_base (487)..(487): a, c, t, g, unknown or other
  misc_feature (487)..(487): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggagcgtggtccagccgtgggagtccctgacgactctcctgtgaagcctcgtggattcagtcttcagtacgtatggtttgcgtcgtgggtcccnccgaggcctccgaggcaaaggggctggctaggtgggtgctatctatatcaatagtaggaaaggaanactaaaataaactaccgtaacgcaagtaccgtacggtagaaacgggacccgtaattccaacctattaccgtaccaagtaacgaaccaactaccccgaaaagaacctaactaactttanactagaacctaaaagcgaaacctaccgtagtaacgtaccgttagaacggtaccgacgggtcttacggttaacttaagtttaacgttggtacggacggtaaaggaggggtaactacgtacgaacttaccgaacgaccgg

SEQ ID NO: 323193 - DNA, 637 bp, Homo sapiens
  misc_feature: GZ8MTXP02JP4AG.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtcgtccccaggacagacggccaggatcacctgctctggagatgcattcgacccaaaccctacttattcttattcggtaccagcagaagccaggccaggcccctgtgttgtgatatataaagacacgtgagacggccttcgacgggtactccctgagcgtattctcgtcggcctccaccgtcgagggacaagtcggtaccaactacttcgaaccctatacgaggttacgggaacgttacccgaggggaccgaaggaaacggacggacgggactacggtaactttatttcgtacgttactaaattctttacaacgtacctattaccgtaggttacggttaaccttaagttcgttacgttacggaacgttacgggaaccgtacggtccgtaccggtccgtaacgtccaaccggacccgaaacggccccaaacccgtcgtaccgtaccgtaccttcgtcccccg

SEQ ID NO: 323194 - DNA, 648 bp, Homo sapiens
  misc_feature: GZ8MTXP02GANOI.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacacgcccaccctcggtcgtccgtcgtccccgaggacagaccggccaggactcacctgctctggagatgcattcgacccaacccactattcttattcggtaccagcagaagccaggccacggcccctgtcttgttgaatataataaacgaccactgagacggtccttacgagggtactcccgaggacgacgtactttcgtcgtcggtcctcccgtaccctacgaacgggaactaaacgtacgggtacctaacgtacgttacgaacctaacgtacgacggtacgggtacggttaccgacgggaccgaaggaaacggaacggacggtcgtacggtacttaacgtttcttacgttacgtaacttacgttacgtaacgtatacccccgttagtacgttacgttaacgtttagttacgttaccgttaccggtaacggttacgggtaaccgttaaaccgg

SEQ ID NO: 323195 - DNA, 503 bp, Homo sapiens
  misc_feature: GZ8MTXP02HP4W9.51.6.A06.1.454.CMB.2.raw
  modified_base (366)..(366): a, c, t, g, unknown or other
  misc_feature (366)..(366): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
  modified_base (425)..(425): a, c, t, g, unknown or other
  misc_feature (425)..(425): n is a, c, g, or t
  modified_base (460)..(460): a, c, t, g, unknown or other
  misc_feature (460)..(460): n is a, c, g, or t
  modified_base (475)..(475): a, c, t, g, unknown or other
  misc_feature (475)..(475): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgaagcctctggattcagtcttcagtacgtagtggtttgcgcgtgggtcccgccgaggcctccgaggcaaggggactggcaggtgggtgcatctatatcatatgaaggaagcaaataaanactacgcagactcgagacggcatcacntcncagagacanacccaagaacactactttanctagacaatcgaacacctgatactgacgacacggntacgtctattactgngcgaagagggtagctacgatacacgacg

SEQ ID NO: 323196 - DNA, 564 bp, Homo sapiens
  misc_feature: GZ8MTXP02H77QO.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggatcacctgctctggagatgcattgcccaacccactattcttattggtaccagcagaagccaggccaggcccctgtgttgtgatatataaagacactgagaggccttacgagggatccccgtgacgcgtattctctggcctccacctcgagggacaatgggtcacattcgacctatcagtggagtccaggcaagaagtacgaggctagtacttattctagtactaaattcttcagtactatacgtagttggttaacttagtgttcgtacggtaacgtcgggaccgtaaaggtcctaaccgttccgtacgggtaccacggaccccgaacggaccccaaacccctacttcgacctacgtcttccccg

SEQ ID NO: 323197 - DNA, 594 bp, Homo sapiens
  misc_feature: GZ8MTXP02FWJDE.51.6.A06.1.454.CMB.2.raw
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
  modified_base (370)..(370): a, c, t, g, unknown or other
  misc_feature (370)..(370): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtctggggggagcgtggtccagccgtgggaggtccctgagactctcctgtgaagcctctggattcagcttcagtacgtattgggttgcgcgtggggtcccnccagggcctccgaggcaaagggactggcaggtggggngctatctatatcgaatagtacggaaaggaanctaaaataaactacaacggcaagacctccgggtaaggaacggggccctaagttccaactatacctaccgaaggaacaacctaaacacccaaaagaaacctacctaactttactacgtagaactaaacgtacgaaccacccttaggactaactgggaacgtaccgacggtctacgtattattacgttcggtgacggaaggagggaactcgtagaactcacaacgg

SEQ ID NO: 323198 - DNA, 652 bp, Homo sapiens
  misc_feature: GZ8MTXP02FX6KU.51.6.A06.1.454.CMB.2.raw
  modified_base (610)..(610): a, c, t, g, unknown or other
  misc_feature (610)..(610): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtattggtttgcgtcgtgggtccgccaggctccgaggcaaggggactggcaggtggggtggctatctatatcatatggaaaggaagcaaaataaaactacgtaaacgcgaaacgtacgtacccggtaggaaaacgggggccctaagttaccaaccctaactacccgtacccaaaggaacgaacctaaaactacccccgaaaaaggaaaccctaacgtaaacccttttagtaccttaacggaaacctaaaacttacggaaaaccaccccttaggaaccgtaacgttagggaacgggtaacacgggtccttacggttacttaacttacgtttacggnggtacggaaagggagggaacgtacgtacgtaatacgacgacg

SEQ ID NO: 323199 - DNA, 625 bp, Homo sapiens
  misc_feature: GZ8MTXP02J1Q9U.51.6.A06.1.454.CMB.2.raw
  modified_base (387)..(387): a, c, t, g, unknown or other
  misc_feature (387)..(387): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtggggacggtccctgacgactctccgtgtgaacgccctgtggattcagtcttcgagttacgtagtggtttcgcgtcgtcgggtccgccgaggcctccgaggaccgaaggggtacctggcgagggtgggtcgcagtctatactcatagtaggaaaggtaanctaaaataaaacgtacacgacaacgtaccgtcccgggtaggaaacggggaccctaacttaccaacctaactcccgtaccaaaggaacgaaaccaaacctaacccgaaagtaaaccactaactttacactacgaacaaatccgaaacctacccgtagacgtaactacggaacgtaccgacggtacctagttacttacttagtcggtggacgaaggtagggatacgtacgacacgacacg

SEQ ID NO: 323200 - DNA, 598 bp, Homo sapiens
  misc_feature: GZ8MTXP02GTJ01.51.6.A06.1.454.CMB.2.raw
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtgggtccaggccgtggggacggtccctgagactctcctgtgaacgcctctggattcagcttcagtacgtattggttgcgtcgtggggtcccgcaggcctccgaggcaaaggggctgacgaggtggggtgcatctatatcatatagaaggaanctaaataaatactacgnagactcgtagaaggccgattacacatctaccagacgaacaaactacccaaaagaaacctaactaactttacaccgtagaactaaatccgaaactacccgtagaacgtaccttagaacggacgtaaccgggtcttacgttacgttaagtttacgttacggtacggtacgggaagggtaacgggtaacgtaacgtacgtaacgtaccgtacgaacg

SEQ ID NO: 323201 - DNA, 504 bp, Homo sapiens
  misc_feature: GZ8MTXP02FGTPG.51.6.A06.1.454.CMB.2.raw
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
  modified_base (415)..(415): a, c, t, g, unknown or other
  misc_feature (415)..(415): n is a, c, g, or t
  modified_base (489)..(489): a, c, t, g, unknown or other
  misc_feature (489)..(489): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggcagatcacctgctctgganatgcattgtccaaacccntattcttaattggaccagcagaagcccaggccaggcccctgtgttgttgatatataaagacactgagaggccttcgagggactcccgtgagcgattctctcggcctccactcgagggacaagtgtcacattgaccatcagtgatccgagcagaagacgaggctagactattcagtcaatctanagacatcagtgtaacttatgtacttggaactcgggaaccagtccacgtcctagccagcccaaggcccaaacccncgtctcactctcccg

SEQ ID NO: 323202 - DNA, 612 bp, Homo sapiens
  misc_feature: GZ8MTXP02HZDOB.51.6.A06.1.454.CMB.2.raw
  modified_base (214)..(214): a, c, t, g, unknown or other
  misc_feature (214)..(214): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcactgctctgganatgcattcgacccaaccctatatttcttaattcggtaccagcaagaagccaggccaggccctgtgttgtgatatataaagacactgagaggtccttagagggactcccgtgacgcgtattctcgtcggtcctcctacctcgaaggggaacctaagtcggtacaatacttcgaactatacaggtcgacgtcccgaaggcgaaagaacggacgaggctagtacttattctagtactattcttacgagtactatcgtaagttcggttaacttagttcgttacgttacggtaaacgttcggggaaacctagggtacctacccggtacgtacggtctaaccgacccgtaaaacggcccctaaacccgtacgttacccgtacctaaccgttccgtttaccccgg

SEQ ID NO: 323203 - DNA, 568 bp, Homo sapiens
  misc_feature: GZ8MTXP02H7Z90.51.6.A06.1.454.CMB.2.raw
  modified_base (348)..(348): a, c, t, g, unknown or other
  misc_feature (348)..(348): n is a, c, g, or t
  modified_base (448)..(448): a, c, t, g, unknown or other
  misc_feature (448)..(448): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggagcgtggtccaggccgtgggacggtccctgagactctcctgtgaacgcctctggattcagtcttcagtacgtatggtttgcgtctgggtcccgccgaggctaccgaggcaagggctggcgaggtgggtggcatctanatcatatagaaaggagacaaagtaaatacctagacagacgtccgtagacggccgtatcaccatctaccgagacgaacactaccaaagaacactactttancagacaaacacgaaccacctagacgtacgttagaacggtacgacggtctacgttaccttagtttaacgttggttaggaccgtaagggaggggtaacgtacgtacgtaacgtcaacgaccg

SEQ ID NO: 323204 - DNA, 603 bp, Homo sapiens
  misc_feature: GZ8MTXP02I5UOT.51.6.A06.1.454.CMB.2.raw
  modified_base (258)..(258): a, c, t, g, unknown or other
  misc_feature (258)..(258): n is a, c, g, or t
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
  modified_base (379)..(379): a, c, t, g, unknown or other
  misc_feature (379)..(379): n is a, c, g, or t
  modified_base (472)..(472): a, c, t, g, unknown or other
  misc_feature (472)..(472): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggaggtccctgagactctcctgtgaagcctntggattcagcttcgagtacgtatggtttgcgtcgtgggtccncgaggcctccgaggcgaagggctggcaggtgggtgcagtcatatcatagngaaaggaanctaaaataaactactacganaacgaccttaccggtaggaaacggccgtaattccgaaccctatcctacccgaagaacgaaccaaactaccccaaaagaacctactaactttanacctagaacctaaaagtcgaaaacccaccgtagaacgtacgttacggaacggtaaccgacggtcctaggtaccttaagttacgttacggtgacggaaggagggaagtacgtacgtaacaccgaacgaacgg

SEQ ID NO: 323205 - DNA, 646 bp, Homo sapiens
  misc_feature: GZ8MTXP02G0Q1D.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgctattcgacccaaaccctacttattcttagttcggtaccagacagaacgccaggccacggcccctgtgttgttgatataataaagacactgagacggcttcgaggctccctgacgcgtattctcgtcggcctccaccgtcgaacgggactaagtcggtacaactagttacgacccgtatcgaggtcggacgtacccgaggacaaggaaacgacggaggctagactttagttctagtactaaatcttacagtactatacgtagtaggttacttagttcgttacgttacggaacgtacggggtaacccgtaaggtcccgtaacccggtaccgttaacgggtacccgaaccggttaacccccgaaacgggtaccccccaaaaccccggtacttccggtttaaaccccaccgtttacccgtttcccccccgg

SEQ ID NO: 323206 - DNA, 517 bp, Homo sapiens
  misc_feature: GZ8MTXP02HR75D.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagccaccctggtgtccgtgtccccaggacagacggccaggatcacctgctctggagatgcattcgccaacccactattcttattggtaccagcagaagccaggccaggcccctgttcgttgttgatatataaagaccactgagaggcttcagggctcccgtgagcgtattctctggctccacctcgagggacaagtcggtacacattcgacctatcagtggacgtccgaggacagaaaggacgaaggctagaacttatttctgtactaaattcttacagtacatcagtgtaacttatcgttctacgacgtacggactaacgg

SEQ ID NO: 323207 - DNA, 620 bp, Homo sapiens
  misc_feature: GZ8MTXP02GPIVO.51.6.A06.1.454.CMB.2.raw
  modified_base (216)..(216): a, c, t, g, unknown or other
  misc_feature (216)..(216): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggactcacctgctctgganatgcattcgacccaaccctattattcttaattcggtaaccagcagagccaggccaggccctgtgttgtgatatataaagacactagagacggtccttcgagggtactcccgtgacgcgtattctcgtcgtctccaccgtacgagggacctaaagtcggtaccactacttacgaccctaagtcgagggttagggacgtacccgaaggaccgaaaggaaacggacgaacgggtctacggtaacttaactttcgtagtacctaaagttcttacacggtaactatacgtagttggtaacttatcgtacttacgtacgtggaccgtaggtacctaccgtactacgggtaccacggtaccccgaacggtaccccaaaccccgtacgttcgtacctaactcctttaccccg

SEQ ID NO: 323208 - DNA, 695 bp, Homo sapiens
  misc_feature: GZ8MTXP02JOIBC.51.6.A06.1.454.CMB.2.raw
  modified_base (302)..(302): a, c, t, g, unknown or other
  misc_feature (302)..(302): n is a, c, g, or t
  modified_base (377)..(377): a, c, t, g, unknown or other
  misc_feature (377)..(377): n is a, c, g, or t
tcagcgatcgtatacacgaccggtgctcgatttagatctactgacaggggtctgggagacgagcccagcactggaagtcgtcggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccaggccgtgggagtccctgagactctcctgtgaacgcctctggattcagtcttcagtacgtatggtttgcgtcgtcgggtccnccgaggcctccgaggcgaaggggctggcgaggtggggtcgctattctaagttatcgtaatagtaggaaaaggaanactaaaataaaataccgtaaccgactaacggtaccgtaccgggtaaggaaacggggtaccctaacttacccaacctaactcccgtacccgaaaggaaacgtaaccaaaaccgtaacccccgaaaagtaaaccctaaacttaaccttttaacaccgttaacgaaacctaaaacgttaccgaaaaccctacccgtaggaaccgtaacgttacgggaacggtaacggtaccgggtaccttaggttaccttaaacgtttacggttcggtaggacggtaaggggaacggggtaatacgttacggaacttaccgaacgaaccgg

SEQ ID NO: 323209 - DNA, 588 bp, Homo sapiens
  misc_feature: GZ8MTXP02H2ZO0.51.6.A06.1.454.CMB.2.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (301)..(301): a, c, t, g, unknown or other
  misc_feature (301)..(301): n is a, c, g, or t
  modified_base (365)..(365): a, c, t, g, unknown or other
  misc_feature (365)..(365): n is a, c, g, or t
  modified_base (476)..(476): a, c, t, g, unknown or other
  misc_feature (476)..(476): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtncaggtcgtgggggagcgtggtccagcctgggacgtccngagctctcctgtgacgctcgtggattcagtcttcagttacgtagtggttgcgcgtcgggtccncgaggctaccgaggcaagggctggcgaggtgggtgcctagtctatatcagtagaggaaaggaanctaaataaactaccgtacgactacgacttacccggtaggaaacggccgtaattccgaacctagttccacaaggaacaacctaacaacccaaagaacctaacttaactttanactagaacaaagtacgaacctaccgagtaacgtacgtagaaacgtacgacggtcttacgtacttacgttacgtgtacggaggtaaggaggtaacgactacgacacgacgacg

SEQ ID NO: 323210 - DNA, 676 bp, Homo sapiens
  misc_feature: GZ8MTXP02HRYQX.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatcacctgctctggagatgcattgaccaacccattattcttaattggtaccagcagaagccaggccaggcccctgtcgttgttgatatataaagacactgagaggccttcgagggactcctgagcgtattctctcggcctaccaccgtcgagggaccaagtcggtacacgattcgaaccataccagtggacgtacccaggaccaggaacggacgacgggtctaggtaaccttagtttcgtagttactaaactttaccgtttacaacgggtaaccctagttaccgtaaggtttacgggttaaactttacgtaacggtttcgtttaaccgggaaacgtttacgggggaaaccctaaaagggttcccgtaaacccggttaccggtaaacgggttccgtaaaccggtacccccgaaaacgggtacccccaaaaaccccctcgttaccggtacccgttaaacccttcccgttttaacccccgg

SEQ ID NO: 323211 - DNA, 592 bp, Homo sapiens
  misc_feature: GZ8MTXP02FNH68.51.6.A06.1.454.CMB.2.raw
  modified_base (259)..(259): a, c, t, g, unknown or other
  misc_feature (259)..(259): n is a, c, g, or t
  modified_base (300)..(300): a, c, t, g, unknown or other
  misc_feature (300)..(300): n is a, c, g, or t
  modified_base (357)..(357): a, c, t, g, unknown or other
  misc_feature (357)..(357): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtctgggggaggcgtggtccagcctgggaggtccctgagactctcctgtgaagccctntggattcagcttcagtacgtatggtttgcgctggggtcccnccaggctccgaggcaaggggctgcaggtgggtgcatctatatcatatagaaaggaancaaaataaactactacgcaagacctccgtagaacgggccgattacaccatcctaccaagaacgaacaaactacccaaaagaaaccaactaactttaatactacgacaaaatacgaaaccaaccccgtagaacgtaacgtttaggaacgggaaccgaacgggcttacgttacttaatttaacgtttggtacggacggaaggaagggggaacgtagtaccggaatacgaacgaacgg

SEQ ID NO: 323212 - DNA, 633 bp, Homo sapiens
  misc_feature: GZ8MTXP02JTR5B.51.6.A06.1.454.CMB.2.raw
  modified_base (258)..(258): a, c, t, g, unknown or other
  misc_feature (258)..(258): n is a, c, g, or t
tcagcgatcgtatacacgaccggtgctcgatttagatctactgacaggggcacgaccggtgctcgatttagatctactgacagggggctgtgggtccaggaggcagaactctgggtgtctcaccatggcctggatccctctacttcctccccctcctcactctctgcacaggctctggaggcctcctatgtgctgacacagcccaccctcggtgtccgtcgtccccaggacagacggccaggatcacctgctctgganatgcattcgcccaacccatattctattcggtaccagcagaacgccaggccaggcccctgtcgttgtgatatataagaccactgagaggtccttcgagggactcccgtgacgtcgattctcgtcggcctccacctcgaagggaccaagtggtaccaacgtacttacgaccctagttacgaggttacgggacgttacccgaagggaccaaagggaaacggaaccggtaacgggtaccgttaggttaacctttaacgttttccgtaacggttactaaaacttccgttacaacggtaactaacgtaccgtaaggttacggttaaactttacgtacgtttaccgttacggtaaaccgtcgggggtaaaccttaaaccggg

SEQ ID NO: 323213 - DNA, 635 bp, Homo sapiens
  misc_feature: GZ8MTXP02H2WN4.51.6.A06.1.454.CMB.2.raw
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
  modified_base (494)..(494): a, c, t, g, unknown or other
  misc_feature (494)..(494): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggaggtccctgagactctcctgtgaagcctctggattcagtcttcagtacgtatggttgcgtcgtgggtccnccgaggcctccgaggcaaggggactggcgtagggtgggtcgctatctagtatcatagtaggaaaggaanacaaattaaataccgtacgcaagactacccgggtagaaacgggcccgtaattccgaacctacgttaccctaccgaagaacgaaacctaaactaccccgaaaagtaaacctaaccttaacttttaanaccctagaacctaaaagtaccgaaaccttacccgaggtaacgtaaccgttagaaacggaccgtaacgggtccttaggttacctaagttttacgtcggtaacgacggtaagggtaggaagtactacggactaccgacgaccg

SEQ ID NO: 323214 - DNA, 644 bp, Homo sapiens
  misc_feature: GZ8MTXP02FXOGY.51.6.A06.1.454.CMB.2.raw
  modified_base (379)..(379): a, c, t, g, unknown or other
  misc_feature (379)..(379): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcggtggtccagccgtggggacggtcctgagctctcctgtgaagcctcgtggattcagtcttcagtacgtagtggttgccggtcgtcggggtcccgccgaggccctcggaggacggaacggggctggcgtagggtgggtgctatactatatacattagaggaaagganactaaaataaactaacgtaccgacgaagtaccgtaccggtaaggaaccggggacctacttaccaacctatccgtaaccgaagaacgaaaccaaaccacccgaaaataaaccctaacttaactttactaccttaacgaactaaaactaccgaaacctacccgtagaacgtacgtaggaacggtaccgtacggtcttacgttacttaagtttacgtacggtcgaacgggtaagggaacgggtagtacgttacgatacgaaccgacgg

SEQ ID NO: 323215 - DNA, 656 bp, Homo sapiens
  misc_feature: GZ8MTXP02FK80L.51.6.A06.1.454.CMB.2.raw
  modified_base (191)..(191): a, c, t, g, unknown or other
  misc_feature (191)..(191): n is a, c, g, or t
  modified_base (309)..(309): a, c, t, g, unknown or other
  misc_feature (309)..(309): n is a, c, g, or t
  modified_base (514)..(514): a, c, t, g, unknown or other
  misc_feature (514)..(514): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtncagctggtgcaggtcgtgggggagcgtggtccaggcctggggacgtccctgagactctccgtgtgaagcctcgtggattcagtcttcgagttacgtatggttgcgtcgtcgggtcccnccgaggcctccgaggcgaagggactggcagggtgggtgctaagtctatatacgatagtagaaaaggaagactaaaattaaaagtacctaacggactaacggtaccttaccgggtagaaacggggccctaattacccaacctacttaccacccgaagaaccgaaactaaaccgtaccccaaaagaaaccctaactaaccttttaanacctaacgaaacctaaacgtacgaaccctacccgtaagaacgtacgtacggaacgtaaccgtacggtcgttacgttactttaagttacgttcggtacggaacggaagggaacgggtaactacgtcgtaactaccgagaaccg

SEQ ID NO: 323216 - DNA, 679 bp, Homo sapiens
  misc_feature: GZ8MTXP02FWQW7.51.6.A06.1.454.CMB.2.raw
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
  modified_base (361)..(361): a, c, t, g, unknown or other
  misc_feature (361)..(361): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagctctctgtgaagccctntggattcagcttcagtacgtatggttgcgtcgtgggtccncgaggcctaccgaggcaaggggctggcagggtgggtgctaatctatatcaatagtagaaaggaanctaaaataaaactacgtaaccgcaaagaccttccggtaaggaaacggggtccctaattaccaaccaattacccacccgaaaggaacgaaaccaaaacctaacccccaaaaaggaaacccctaaacttaaacccgtttttaaactaccgtaaacgaaacctaaaacgtaaccgaaaccctaaccgtaagaacgtaacgtagggaaacggtaaccgtacggtacgttacgttaaacttaacgtttacgttacggtacggaacgggtaaaggggtaaggggtaaaccgtaacgtaaccggtaaacgtaaccgtaacgaacg

SEQ ID NO: 323217 - DNA, 638 bp, Homo sapiens
  misc_feature: GZ8MTXP02GMWVW.51.6.A06.1.454.CMB.2.raw
  modified_base (292)..(292): a, c, t, g, unknown or other
  misc_feature (292)..(292): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctcgtggagatgcattcgacccaaccctattattcttattcggtaccagcagaagccaggccagcccctgtgttgtgatanataaagacactgagacggccttacgagggactcccgtagacgacgtatttccctcgtggccttacccaccgttacgaacggggtaccaaagttcgggtaccaaacgtacgttacgaaacctagttaccagggttacggaacgtacccgagggacaaaggaacggaacgacggtacgtagtactttaagtttccgtagttactaacttcttacgagaacctagtacgtagttaggttacttagtcggtacgttacggtaacggtaggtaaccgtaaaggtccgtaaccgtaccgttacggactaaccggacccgaacggaccccaaacccgtactcgtacctaaccg

SEQ ID NO: 323218 - DNA, 593 bp, Homo sapiens
  misc_feature: GZ8MTXP02I83TQ.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatcacctgctctggagatgcattcgaccaacccatattcttattggtaccagcagaagccaggccaggcccctgtcgttgtgatatataaagacactgagacggcttgaggactccctgagcgtattctctcggcctccactcgacggacaagtggtcatagttcgaccatcagtgactccgaggacagaagacgtaacggctagacttatttccgtagtactaaattcttacagtaccataccgagttaggttaacctttatcgttacttacgggaaacgtcggggtaacctaaaggggtcctaaccggttaccgtacggttaccgaaccgaccccgaaaaggttacccccaaaccccgtaacgtcgttaccctaaccgttctttaacccccgg

SEQ ID NO: 323219 - DNA, 585 bp, Homo sapiens
  misc_feature: GZ8MTXP02G0F2D.51.6.A06.1.454.CMB.2.raw
  modified_base (238)..(238): a, c, t, g, unknown or other
  misc_feature (238)..(238): n is a, c, g, or t
  modified_base (300)..(300): a, c, t, g, unknown or other
  misc_feature (300)..(300): n is a, c, g, or t
  modified_base (365)..(365): a, c, t, g, unknown or other
  misc_feature (365)..(365): n is a, c, g, or t
  modified_base (460)..(460): a, c, t, g, unknown or other
  misc_feature (460)..(460): n is a, c, g, or t
  modified_base (479)..(479): a, c, t, g, unknown or other
  misc_feature (479)..(479): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtggggagtcccngagactctcctgtgagcctctggattcagcttcagttacgtatggtttgcgtcgtgggtccnccgaggctccgaggcaaggggactggcgaggtgggaggcatctaatatcaatataggaaaggaancgaaaataaatactacgacaagacctaccggtagaaacggggccctaattaccaacctagtacctaccgaagaacgaaccaaactaccccaaaanaacctaaactactttaaanccctagaaccaaaattacgaaaccacccgtagacgtacgttaggacgaacgacggtctcgtacttaattgtacgtgacggaaggtaggactagacgactcgagacg

SEQ ID NO: 323220 - DNA, 558 bp, Homo sapiens
  misc_feature: GZ8MTXP02I8TFO.51.6.A06.1.454.CMB.2.raw
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
  modified_base (503)..(503): a, c, t, g, unknown or other
  misc_feature (503)..(503): n is a, c, g, or t
  modified_base (526)..(526): a, c, t, g, unknown or other
  misc_feature (526)..(526): n is a, c, g, or t
  modified_base (541)..(541): a, c, t, g, unknown or other
  misc_feature (541)..(541): n is a, c, g, or t
  modified_base (550)..(550): a, c, t, g, unknown or other
  misc_feature (550)..(550): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagactctctgtgacgcctcgtggattcagtcttcagtacgtatggtttgcgtcgtgggtcccnccgaggcctccgaggcaagggctggcgaggtgggtgcagtctatatcatataggaaagaanctaaaataaactactaccgcaagaccgtccggtagaaacgggtcctattaccaacctatccaccaagacaacaaactacccaaagaaccactactttagctagaaccaaatcgaaaccaccgtagacgtacgtagacgaacncggtactcgtactattacgtggngacggaaggtagganacgtagacncaacgacg

SEQ ID NO: 323221 - DNA, 579 bp, Homo sapiens
  misc_feature: GZ8MTXP02HV9FX.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacaggacggccaggatcacctgctctggagatgctattcgacccaacccattattcttattcggtaccagcagaacgcaggccaggccctgtgttgtgatataataaagacatgagaggtccttcgagggactcccgtgacgcgtattctcgtcggcctccacctcgaggacagtggtacatattgaaccagtcaggtggacgtccgagggacaaggaagacggaggctaggacttatttcgtagttacaatttcttacaagactatcgagttgtttataagtgttacgtacggtaacgtcgggaacctagggtaccaccggttaccgtacggtcgaaccgcccgaaacggccccaaaccccgtactaccgtacctccttacgtttacccccg

SEQ ID NO: 323222 - DNA, 589 bp, Homo sapiens
  misc_feature: GZ8MTXP02ID1GP.51.6.A06.1.454.CMB.2.raw
  modified_base (432)..(432): a, c, t, g, unknown or other
  misc_feature (432)..(432): n is a, c, g, or t
  modified_base (447)..(447): a, c, t, g, unknown or other
  misc_feature (447)..(447): n is a, c, g, or t
tcagcgatcgtatacacgaccggtgctcgatttagatctactgacagggggctgtgggtccaggaggcagaactctgggtgtctcaccatggcctggatccctctacttctcccccctcctcactctctgcacaggctctgaggcctcctatgtgctgacacagccaccctcggtgtccgtgtccccaggacagacggccaggatcacctgctctggagatgcattcgacccaaacccattattcttatttggtaccagcagaagccaggccaggcccctgtgttgttgatataataaagacactgagaggcctttgagggatcccgtagagcgtattccctctggctccactcgagggacaagtggtccactattcgacctatcagtggacgtccgaggacaaggaagacgaggctacgacttatttcgtntactaattcttacanacatcgtaagtcggttaactttagtcgttacgtttcgggaacgttacggggaaacctaacgggtaccgtaacccgttaccgttaacgtaccgaacccgacccgaaaccggacccaaacccccgtacctacgtacctaacccg

SEQ ID NO: 323223 - DNA, 519 bp, Homo sapiens
  misc_feature: GZ8MTXP02FQND0.51.6.A06.1.454.CMB.2.raw
  modified_base (296)..(296): a, c, t, g, unknown or other
  misc_feature (296)..(296): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccnccaggctccgaggcaaaggggctgcaggtggggtgcatctatatcaatatggaaaggaagcaaataaaatactacgcaagactccgtagaaggccgatcacatcncagagacaanccaaagaaccacactttaanctagacaaatacgaacacctagagtacgtagaacgacacggctgtactattacgtagtgacgaagagggatacgtacgactacacacg

SEQ ID NO: 323224 - DNA, 700 bp, Homo sapiens
  misc_feature: GZ8MTXP02H14OS.51.6.A06.1.454.CMB.2.raw
  modified_base (172)..(172): a, c, t, g, unknown or other
  misc_feature (172)..(172): n is a, c, g, or t
  modified_base (190)..(190): a, c, t, g, unknown or other
  misc_feature (190)..(190): n is a, c, g, or t
  modified_base (315)..(315): a, c, t, g, unknown or other
  misc_feature (315)..(315): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagnggtgtccagtgtcaggtncagctggtgcaggtcgtgggggaggcgtggtccaggccgtgggacgtccctgagtacctctcctgtgacgtcctcgtggattcgagtcttacgagttacgtgtggttgccgtcgtcggggtcccnccgaggcctccgagggcaaggggctggacgtagggtggggtcgctaagttctaattatactagtaagtaggaaaggtaacactaaaattaaaactacccgtaacgactaacggtaaccttacccgggtaaggggaacggcccgtaacttacccaaaccctacttacccgtaaccccgaaggtaaccgaaaaccctaaaccgttaacccccaaaaaggtaaaccctaaaccttaaaccttttaacgtaaccttacgaaactaaaactcgaaaaccctaccgtagaacgtacgtaggaacggtacacggtacttacgttacttaagtttacgttaggtacggagggtaaaggagggtaaacgtaccgtacgaacgtaccaacgaccg

SEQ ID NO: 323225 - DNA, 556 bp, Homo sapiens
  misc_feature: GZ8MTXP02JOV1I.51.6.A06.1.454.CMB.2.raw
  modified_base (198)..(198): a, c, t, g, unknown or other
  misc_feature (198)..(198): n is a, c, g, or t
  modified_base (300)..(300): a, c, t, g, unknown or other
  misc_feature (300)..(300): n is a, c, g, or t
  modified_base (359)..(359): a, c, t, g, unknown or other
  misc_feature (359)..(359): n is a, c, g, or t
  modified_base (378)..(378): a, c, t, g, unknown or other
  misc_feature (378)..(378): n is a, c, g, or t
  modified_base (434)..(434): a, c, t, g, unknown or other
  misc_feature (434)..(434): n is a, c, g, or t
  modified_base (456)..(456): a, c, t, g, unknown or other
  misc_feature (456)..(456): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtncagtctgggggagcgtggtccagcctgggaggtccctgacgactctcctggtgaagccctctggattcagcttcagtacgtatggtttgcgtcgtgggtccncgaggcctccgaggcaaggggctgcaggtggtgctatctaatatcatagtgaaaggaancaaaataaaacgtctacgnacggaaccttccgtaggaaacgggccctataccacccaatccaccagaacaacaanaccccaaagaaccacactttanactacgaactaaacacaaaccaccctagaactacgtgaacgacacggctacgtcttaaagtttctagtgacggaaggaggacacgtacgactacacgacg

SEQ ID NO: 323226 - DNA, 670 bp, Homo sapiens
  misc_feature: GZ8MTXP02GM7CB.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgtttgcttcttttaagaggtgtccagtgtcaggtgcagctggtgcaggtcgtgggggagcgtggtccagccgtgggacggtccctgacgtactctcctgtcgagccctcgtggtattcagtcttcgagttacgtattggttcgcgtcgtcgggtcccggccgacggtccgtccgacggacggaacgggtacgtcgtcgacgggtggggtggtacgacttacgtatagtacatagtacggtaaggaagactaaataaaataaccgtacgacgtacgaacgtccgtagggaacgggaccgtacttaccgaccacttacgtacccgaagaacgaacaaacctaaccccgaaacgtaaacctaccttaaactttactactacgaacgtaaaactaacggaaccctaaccgtagaacgttacgtacgaacgaaccggtacgtacgttcgttaacgttacttacgttaggtaggtacggtaagggaacgggtaagacgttacggaactacgaacgacgg

SEQ ID NO: 323227 - DNA, 647 bp, Homo sapiens
  misc_feature: GZ8MTXP02GY1NB.51.6.A06.1.454.CMB.2.raw
  modified_base (263)..(263): a, c, t, g, unknown or other
  misc_feature (263)..(263): n is a, c, g, or t
  modified_base (304)..(304): a, c, t, g, unknown or other
  misc_feature (304)..(304): n is a, c, g, or t
  modified_base (516)..(516): a, c, t, g, unknown or other
  misc_feature (516)..(516): n is a, c, g, or t
  modified_base (586)..(586): a, c, t, g, unknown or other
  misc_feature (586)..(586): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtggggggaggcgtggtccaggccgtggggagtccctgacgactctcctgtgaagcctntggattcagtcttcagtacgtatggtttgcgcgtgggtccncgaggctccgaggcaagggctgcgtaggtgggtgcagtctatactcaatataggaaaaggaagtaccaaaattaaaactaccgtaacgacaaaggaccttacccggtagggaaacggggccctaattacccaaccctaattcccgtaacccgaaggaacgaaacctaaaccgtacccccaaaaaggtaaccctaaaccttaactttttaacnccgttaggaaaccctaaaagttaccgaaaccctacccgtagaacgtaccgttaggaacggtacgacggtnttacgtcttaagtttacgttggacgtagaaggagggacgtactacggtactaccgacacgg

SEQ ID NO: 323228 - DNA, 634 bp, Homo sapiens
  misc_feature: GZ8MTXP02IF2FE.51.6.A06.1.454.CMB.2.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
  modified_base (342)..(342): a, c, t, g, unknown or other
  misc_feature (342)..(342): n is a, c, g, or t
  modified_base (352)..(352): a, c, t, g, unknown or other
  misc_feature (352)..(352): n is a, c, g, or t
tcagcgatcgtatacacgaccggtgctcgatttagatctactgacaggggtctgggagacgagcccagcactggaagtcgccggtgtttccattcggtgatcatcactgaacacagaggactcacatggagtttgggctgagcttgggttttcctcgttgctcttttaagaggtgtccagtgtcaggtgcagctggtncagtcgtgggggagcgtggtccagcctgggagtcctgacgctctcctgtgaagtcctgtggattcagcttcagtacgtatggttgcgcgtggtccncgagcctcgaggccgaagggctggcaggtgggtgcatctatatcatanagaacggaanactaaaattaaatcctaacgcaacgtactaccgggtagaaacggcctaacttaccaacctaacttccaccgaagaacgaaccaaaacgtaccccaaaagtaaaccctacttaaccgtttttaacacgttaacaaactaaactaccgtaaaccctaccgtaggaacgttaacggtaacggaaccggtaaccgtacggttacgttacgttacgttaaacgtttacgttcggtaacggacggtaaagggacgggtaacgtacgtaacgtactaacgaacgtaacg

SEQ ID NO: 323229 - DNA, 590 bp, Homo sapiens
  misc_feature: GZ8MTXP02HN2D5.51.6.A06.1.454.CMB.2.raw
  modified_base (458)..(458): a, c, t, g, unknown or other
  misc_feature (458)..(458): n is a, c, g, or t
  modified_base (535)..(535): a, c, t, g, unknown or other
  misc_feature (535)..(535): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtgcagtcgtgggggaggcgtggtccagccgtgggaggtccctgagctctctgtgaacgcctctggattcagtcttcagtacgtatggtttgcgtcgtgggtcccgccaggctccgaggcgaaaggggcctgcaggtgggtgcagtctatatcattaagtggaaaaggaagactaaataaaactaactaccgacaacgacttcccggagaacgggaccgattaccaacactcctaccaagaacaaccaaactaccccaaaanaaaccaactaactttactacgtacgaacaaagtacaaacctacccgtagacgtacgttaggaacgtacgaaccggtntacgtacttattacgtcggtgacggaaggaggaacgtacgtacgactacacgacg

SEQ ID NO: 323230 - DNA, 546 bp, Homo sapiens
  misc_feature: GZ8MTXP02JTXK8.51.6.A06.1.454.CMB.2.raw
  modified_base (254)..(254): a, c, t, g, unknown or other
  misc_feature (254)..(254): n is a, c, g, or t
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
  modified_base (448)..(448): a, c, t, g, unknown or other
  misc_feature (448)..(448): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagctctcctgtgagcctntggattcagtcttcagtacgtntggttgcgtctgggtccncaggctcgaggcaagggctgcaggtgggtgcatcatancatagtgaaaggancaaataaatactacgacagacctccgtagaacgggccgtattccgacctagtacctacccgaagaacgaaccaaactacccgaaaagacctaactactttanactagactaaatcgaaacacccgtgaacgtactagaacgtacgacggctacgtcttaattagtcggtgacgaaggagggagactacgactacacgacg

SEQ ID NO: 323231 - DNA, 614 bp, Homo sapiens
  misc_feature: GZ8MTXP02FQMDJ.51.6.A06.1.454.CMB.2.raw
  modified_base (307)..(307): a, c, t, g, unknown or other
  misc_feature (307)..(307): n is a, c, g, or t
  modified_base (373)..(373): a, c, t, g, unknown or other
  misc_feature (373)..(373): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtggggaggtccctgagactctcctgtgaagccctctggattcagcttcaggttacgtatggtttgccgtcgtggggtcccnccgaggcctccgagggcaaggggcctggcgaggtgggtgcatctatatcaatagtaggaaaggaanacaaataaaactactacgctaagacctccggtaggaaacgggccgaacttacacctatacctaccaagaacgaacaaactacccaaaacgaaacaactaactttatacttacgaacaaaacgtacgaaaccctacccgtaggaacgtaacgttacggaacggaacgacgggtacttacggtacttaatttacgttcggtagacggaaggaaggggagtaacgtacgacgtaccgagaaccg

SEQ ID NO: 323232 - DNA, 587 bp, Homo sapiens
  misc_feature: GZ8MTXP02H0IMM.51.6.A06.1.454.CMB.2.raw
  modified_base (260)..(260): a, c, t, g, unknown or other
  misc_feature (260)..(260): n is a, c, g, or t
  modified_base (309)..(309): a, c, t, g, unknown or other
  misc_feature (309)..(309): n is a, c, g, or t
  modified_base (504)..(504): a, c, t, g, unknown or other
  misc_feature (504)..(504): n is a, c, g, or t
  modified_base (557)..(557): a, c, t, g, unknown or other
  misc_feature (557)..(557): n is a, c, g, or t
  modified_base (585)..(585): a, c, t, g, unknown or other
  misc_feature (585)..(585): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcagggtgcagctggtgcagtcgtgggggagcgtggtccagcctgggacgtcctgagactctcctgtgaacgtcctntggattcagtcttcagttacgtagttggtttgcgtcgttcggggtcccnccgagggcctcccgaaggaccgaaaggggcctgggcgaggtggggtcggcagttctaagtactcatagtaggaaaggaacacaaaattaaaactactacgacaacggacctcgtagaacggaccgtattacaaccatctaccagaacgaacaactacccgaaagaaacctaactaactttacactacgactaaanacgaacctaccgtagacgtacgtagacgacgacgtctacgtactatacgtcgngagaaggaggatacgtacgacacgaacncg

SEQ ID NO: 323233 - DNA, 554 bp, Homo sapiens
  misc_feature: GZ8MTXP02FGIF5.51.6.A06.1.454.CMB.2.raw
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
  modified_base (417)..(417): a, c, t, g, unknown or other
  misc_feature (417)..(417): n is a, c, g, or t
  modified_base (429)..(429): a, c, t, g, unknown or other
  misc_feature (429)..(429): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtctgggggaggcgtggtccagcctggggagtccctgagactctcctgtgaagcctctggattcagcttcagtacgtatggtttgcgcgtgggtccncaggctccgaggcaaggggctgcaggtgggtgnatctatatcatatggaaaggaancaaaataaactacacgcaagtacctcggagacggcctatcacatcacagacacaacaccaaanaacactacttanctagaacaaatacgaaaccaccgtagaacgtacgtaggaacggaacgacggtcttacgtacttaagttacgttcggacggtacggaagggaacgggtacgtacgtacgtaactaccgaacgtacg

SEQ ID NO: 323234 - DNA, 611 bp, Homo sapiens
  misc_feature: GZ8MTXP02HR9IZ.51.6.A06.1.454.CMB.2.raw
  modified_base (386)..(386): a, c, t, g, unknown or other
  misc_feature (386)..(386): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaacctatattcttagttggtaccagcagaagccaggccacggcccctgtgttgtgatatataaagacactgagacggtcttacgagggtactcccgtagagcgtattctcgtcggcctccactcgaggacaagtcggtacactattacgaccatcagngacgtaccgaggacaaggaagacgaggctagtacttattcgtagttactaattctttacgatacctatacgtagttaggttactttagtcgtttacgttacggtaaacgttacggggaaaccgttaacggtacccgtaacccggttaccgtaacgggtacctaaccggacccgaaaccggtaccccaaaccccgtactacggtacctaccgttacctttcccccg

SEQ ID NO: 323235 - DNA, 663 bp, Homo sapiens
  misc_feature: GZ8MTXP02G8SHR.51.6.A06.1.454.CMB.2.raw
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
  modified_base (611)..(611): a, c, t, g, unknown or other
  misc_feature (611)..(611): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccaggccgtggggacgtccctgagactctctgtgagcctntggattcagtcttcgagtacgtagttggttgcgtcgtgggtcccnccgaggcctaccgaggcgaaggggtactggcgtaggtggggtagctattcgtatagtctaagtagtaggaaaaggtaacgactaaaattaaaactaccgtaacgacaaggtaccgttacccgggtaagggaaacgggtcccgtaattccgaaccctattcccaacccgagaaacgaaccaaactaccccaaaagaacctacttaactttacgactacgaactaaactacgaaccctaccgtagaaccgttacgtaacggaacgtaaccgtacggtacttacggttaaccttaggtttacgttacggnggtaacgggtaaaggggacggtaaagtacgtacgacttaaccgaacgtccgg

SEQ ID NO: 323236 - DNA, 626 bp, Homo sapiens
  misc_feature: GZ8MTXP02FK620.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgcattcgacccaacccattattcttattggtaccagcagaacgccaggccacggccctgtgttgttgatataataaagacactgagaggtccttcgaggtactcccgtaggacgtcgtattctcgtcggtcctcccaccgtcgaggacaagtcggtacactattcgacatcgagtagatccgaggacaggaagacgaggtctagtactagtttctagtactaaagttcttacgaacgtaactattacgtaaggtttacgttaactttagttcggttaacgtttaccgggaaacggttacggtaacccgtaaaacgggttcccgtaaccggttaccgttacgggaccgtaacccgaccccgaaacggaccccctaaacccacgttccgtacctaccgtctttacccccg

SEQ ID NO: 323237 - DNA, 562 bp, Homo sapiens
  misc_feature: GZ8MTXP02HW7AM.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgcccaacccactattcttattggtaccagcagaagccaggccaggcccctgtgttgtgatatataaagacactgaagaggcctttacgagggactccctgagcgattctctggcctcccactcgagggacaagtcggtacacattcgaccatccagtgacgtccaggcagaaagacgaggctagacttattctagtctaaattcttacagacatcgagtggttacttaagtgttacgttcgaaacgtcggaaccctaaagggtccaccggtacctacgggtaccgacgtacccgaacggaccccaaaccccgtactacgtaccctacttcgttaccccg

SEQ ID NO: 323238 - DNA, 575 bp, Homo sapiens
  misc_feature: GZ8MTXP02JRYDF.51.6.A06.1.454.CMB.2.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
  modified_base (557)..(557): a, c, t, g, unknown or other
  misc_feature (557)..(557): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtncagtcgtgggggagcgtggtccagcctgggagtccctgagactctcctgtgaagcctcgtggattcagtcttcagtacgtatggttgcgcgtgggtccncaggctccgaggcaagggctgcaggtgggtgcagtctaagtatcatagtaggaaaggaagacaaaagtaaatacctacgcaagacttccggtagaacgggcgattaccgacctatcctaccaagaacgaacctaaactacccaaaagaacctaactactttaacactacgaacaaagtacgaaacctacccgtagaacgtacgttagaacggtaccgacggtctaggtacttaacttagttacgtgaggaaggacggganacgtagactacgacgacg

SEQ ID NO: 323239 - DNA, 528 bp, Homo sapiens
  misc_feature: GZ8MTXP02FQ06Q.51.6.A06.1.454.CMB.2.raw
  modified_base (258)..(258): a, c, t, g, unknown or other
  misc_feature (258)..(258): n is a, c, g, or t
  modified_base (300)..(300): a, c, t, g, unknown or other
  misc_feature (300)..(300): n is a, c, g, or t
  modified_base (360)..(360): a, c, t, g, unknown or other
  misc_feature (360)..(360): n is a, c, g, or t
  modified_base (405)..(405): a, c, t, g, unknown or other
  misc_feature (405)..(405): n is a, c, g, or t
  modified_base (441)..(441): a, c, t, g, unknown or other
  misc_feature (441)..(441): n is a, c, g, or t
  modified_base (484)..(484): a, c, t, g, unknown or other
  misc_feature (484)..(484): n is a, c, g, or t
  modified_base (500)..(500): a, c, t, g, unknown or other
  misc_feature (500)..(500): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctggggagtccctgagactctcctgtgaagccctntggattcagcttcagtacgtatggtttgcgtctcggggtccnccgaggcctccgaggccaaaggggctgcaggtgggtgcatctatatcatatgaaaggaancaaataaatactacgcaagactccgtagaacgggcatcacatccnccaagagacaactacccaaagaaccaactactttanctacgacaaaatcgaacaccctgacgacttgaacgacacggtntcgtactatacgtcgngagaaggagacgacgacgactacacacg

SEQ ID NO: 323240 - DNA, 718 bp, Homo sapiens
  misc_feature: GZ8MTXP02HFRJ6.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaacccacttattcttatggtaccagcagagccaggccaggccctgtgttgttgatataataaagacactgagacggtccttcgagggtactcccgtagagtcgtatttcctcgtcggcctcccaccgtcgaaggggacctaagtcgggtacctaactatttacgaacctagtccgaaggttcgggagtcccgaaggccgaaaggaaacgaccggagggtaccttaggtaaccttacgtttcgtaggttactaaacgtttctttaaccgaaggttaacctagttacccgtaaggggtttacgtttaaaccgttttagtacggtttaccgttttacggggaaaaccgtttacggggaaaccccgtaaaggggttccccctaaaccgggtacccgtttaacggggtacccaaccggtaacccccgaaaccggggaccccctaaaacccccgttacgtacccggtaccctaaccgtttcccgtttacccccgg

SEQ ID NO: 323241 - DNA, 688 bp, Homo sapiens
  misc_feature: GZ8MTXP02IEFN8.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggatcacctgctctggagatgcatttgaccaaccctactattcttattggtaccagcagaagccaggccaggcccctgtgttgtgatatataaagacactgagaggcttcgagggactcccgtgagacgtattcgtcgtacggccctacccgaccttcgaaggggtaaccaagttcgggtaccaacctagtttacgaaccctaattaccgaaggtacgggtacgtacccgaaggggaccaaagggaaacgaacggtaacgggcctaggtaacttaacgttttcctagttacctaaattctttacaagtaacctatacgtaggttacgttaacgtttatttacggttacgtttacgggtaaacgtttacggggaaacccgtaaaggggttacccctaaccggttaccgttaccgggtacgtaacccgacccgaaaccgggtaccccaaacccccggtactaccggtaccctcctttaaccggtttcccccg

SEQ ID NO: 323242 - DNA, 601 bp, Homo sapiens
  misc_feature: GZ8MTXP02I31AY.51.6.A06.1.454.CMB.2.raw
  modified_base (214)..(214): a, c, t, g, unknown or other
  misc_feature (214)..(214): n is a, c, g, or t
  modified_base (445)..(445): a, c, t, g, unknown or other
  misc_feature (445)..(445): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatcacctgctctgganatgcattgacccaaacccactattcttagttcggtaccagcagaagccaggccacggccctgtcgttgtgatatataaagacactagagacggtccttacgagggactcccgtagacgcgtattctctcggcctccacctcgagggacaagtcggtacactattcgaccagtcgagtgagtaccgaggacaagaagacgaggtctagacttattctagtactaattcttanagtacatctagtgtacttagtcgttacgttacggaagttacgggaaccgtaaggtacctaaccggttaccgttacggtaccgaacccgaacccgaaacgggtacccccaaacccctaaccgtccggtacccgtaaccgtttaccctttacccccgg

SEQ ID NO: 323243 - DNA, 620 bp, Homo sapiens
  misc_feature: GZ8MTXP02G8FV1.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccacccgtcggtgtccgtgtccccaggacagacggccaggactcacctgctctgagatgcattgccaaccactatcttatggtacagcagaagcagcaggccctgtgtgtgatatataaagacactgagacgccttagagggactcccgtgaacgcgtaattctcttcggcttccaaccctgaacgggacaaagttcggacaactagttacaaccattacgaggttaggacgtccgaaggacgaagaaaaccgacgttaaagggccttaggaacctttaaatttccgtagttaacccaaaagttttcccgtttaaacgtaacgtaacgtaacgttaacgttaacggttaacgtttaacgtttaacgtttacgtttaccggtttaaccggttaaacggttaaccgggtaaaccggtaaaccgg

SEQ ID NO: 323244 - DNA, 626 bp, Homo sapiens
  misc_feature: GZ8MTXP02JU0G3.51.6.A06.1.454.CMB.2.raw
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (508)..(508): a, c, t, g, unknown or other
  misc_feature (508)..(508): n is a, c, g, or t
  modified_base (565)..(565): a, c, t, g, unknown or other
  misc_feature (565)..(565): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagtctgggttttcctcgttgctcttttaagaggtgtccagtgtcaggtgcagctggtgcaggtcgtgggggagcgtggtccagccgtgggacgtcctgacgctctctgngaacgcctnggattcagtcttcagtacgtatggttncgcgtgggtcccncgaggcctcgaggcaaaggggctggacgaggtgggtgcattcgtagtactanagttanaggaaagggtaaacacgtaaaactaaacgtaccgtacgacgaacggtacccgtacgggtaacgaaccgggtaccctaacgttacccacctaacgtacccaccgaagaaccgaaccaaacgtaacccaaacgtaacctaacgttactttanacgtacgaacaaacgtaccgaacctaccgtagacgtaacgtgaacggaccgacggtntacgtacttattacgtcggtaggacggaagggacggtacgtacgtacgtactacgaacgcg

SEQ ID NO: 323245 - DNA, 524 bp, Homo sapiens
  misc_feature: GZ8MTXP02HRPQR.51.6.A06.1.454.CMB.2.raw
  modified_base (219)..(219): a, c, t, g, unknown or other
  misc_feature (219)..(219): n is a, c, g, or t
  modified_base (309)..(309): a, c, t, g, unknown or other
  misc_feature (309)..(309): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctgganatgcattgcccaaccactattcttattggtaccagcagaagcaggccaggcccctgtgttgttgatatataaagacactgagaggccttnagggatccctgagcgattcctctgctccactcagggcagtggtcactattgacatcagtggcgtacaggcagaagacgaggctagtactagtttctgtactaattcttacagaccatcgaagttgtacttagtgttcttcggtaactgggacaaggtccacccgtcgtaacggtcaacgtacccgaacgtacccaaccccgactacgtctacccg

SEQ ID NO: 323246 - DNA, 681 bp, Homo sapiens
  misc_feature: GZ8MTXP02HC91F.51.6.A06.1.454.CMB.2.raw
  modified_base (378)..(378): a, c, t, g, unknown or other
  misc_feature (378)..(378): n is a, c, g, or t
  modified_base (563)..(563): a, c, t, g, unknown or other
  misc_feature (563)..(563): n is a, c, g, or t
  modified_base (664)..(664): a, c, t, g, unknown or other
  misc_feature (664)..(664): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagcgtggtgcgaggtcgtgggggaggcgtggtccagccgtgggacggtccctgagtctctctgtgaacgcctgtggtacttcgacgtcttacgaggttacgttagttggtttcggccgtccgttcggggtccccgccgtacgggcctcccggaggaccgaaaggggctcgggcgtagggtcggggngacctatttcctaagtatactaagttaagtaggaaaaggaaacgactaaaattaaaacgtaccgtacgaccaacggtacccgttccgggtaacgggaaaccgggtacccgtactaccaccctaactaccctaccgaacgtaacaaccaaaccgtacccgaaaacgaaaccttaactaactttaanacccttagaaactaactacgaacctacccgtagaacgtaccgtagaccgtacgtacggtaccttagtcgtaatttcgtcggtagtacggaaggaacgacgngtacgactacgacgacg

SEQ ID NO: 323247 - DNA, 568 bp, Homo sapiens
  misc_feature: GZ8MTXP02FP9OC.51.6.A06.1.454.CMB.2.raw
  modified_base (445)..(445): a, c, t, g, unknown or other
  misc_feature (445)..(445): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtgggggagcgtggtccagccgtgggagtccctgagctctctgtgagcctctggattcagcttcagttacgtatggtttgcgtcgtgggtccgccaggcctccgaggcaaggggctgcgaggtgggtgcatctatatcatatggaaaggagcaaataaatactaacgcaagtacctaccgtagaacggggaccctaattcaacctattaccaccgaagaacgaacaaaactacccaaaanaacctaactaactttataccttagaccaaaactcgaaaccaccctagactacgtacgaagaccgaggtctagttactaagtttacgtacgtgacggaaggaggacgtagtacgaacacagacg

SEQ ID NO: 323248 - DNA, 535 bp, Homo sapiens
  misc_feature: GZ8MTXP02HVYXP.51.6.A06.1.454.CMB.2.raw
  modified_base (189)..(189): a, c, t, g, unknown or other
  misc_feature (189)..(189): n is a, c, g, or t
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
  modified_base (424)..(424): a, c, t, g, unknown or other
  misc_feature (424)..(424): n is a, c, g, or t
  modified_base (527)..(527): a, c, t, g, unknown or other
  misc_feature (527)..(527): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcagtcgtgggggagcgtggtccagcctgggagtccctgagactctctgtgaacgcctntggattcagtcttcagtacgtatggttgcgtcgtgggtccncaggcctaccgaggcaagggctgcaggtgggngcatctatatcatatgaaaggancaaataaatcacgnagctcgngaaggccatcacatctaccagacaacactacccaaagaacaactactttanactagacctaaaatcgaaacacctagaacgtaaccgttgaaacgtaccgaggtccttagtacttaattcgtacgtggacgaaggtacgggagactacgtaacncaacgacg

SEQ ID NO: 323249 - DNA, 645 bp, Homo sapiens
  misc_feature: GZ8MTXP02G39F9.51.6.A06.1.454.CMB.2.raw
  modified_base (175)..(175): a, c, t, g, unknown or other
  misc_feature (175)..(175): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtntccgtgtccccaggacagacggccaggatcacctgctctggagatgcattcgcccaaccatattcttattggtaccagcagaagcaggccaggccctgtgttgtgatatataaagcactgagacgtccttcgagggactcccgtgaagcgtattccctacgtcggcctcccacctacgacgggactaaagtcggtaccactattacgacctatccgaggttacggaacgtccgaaggacgaaggaaacggacggtaggaccttagaccttaatttccgtagtactaattccttagaactactacgtacgtaggtttacggttacctttaagttcgttaacccggttttacggaaaccgtttacggggaacccgttaaacgggtacccgttaacccgttacccggttagggtaccaacggtaaccccgaaacgggtaccccaacccccggtacttacggtacttaaccccg

SEQ ID NO: 323250 - DNA, 675 bp, Homo sapiens
  misc_feature: GZ8MTXP02G1Y72.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccaggccgtggggacgtccctgagactctcctgtgaagcctcgtggattcagtcttcagtacgtagttggtttgcgtcgtcgggtccgcgaggctccgaggcgaaggggctggcgaggtggggtcgctagttctatatcaatagtaggaaaggaagactaaaattaaaactacgtaacgacaagtaccgtcggtacggaaacgggccctaagttaccaacccgtactccgtaaccgaagaacgaaacctaaaccgtaaccccgaaaagtaaaccctaaacttaacttttaactacgtacgtaaacctaaaacgtacgaaaaccctaacccgtaggaacgtaaaccgttaggaaacgggtacccgtaacgggttcttacggttaccttaagttttacgttggttaacggacggtaagggaagggtaacgtagttaccggaactaccgaacgaaccgg

SEQ ID NO: 323251 - DNA, 497 bp, Homo sapiens
  misc_feature: GZ8MTXP02FJB1L.51.6.A06.1.454.CMB.2.raw
  modified_base (296)..(296): a, c, t, g, unknown or other
  misc_feature (296)..(296): n is a, c, g, or t
  modified_base (351)..(351): a, c, t, g, unknown or other
  misc_feature (351)..(351): n is a, c, g, or t
  modified_base (393)..(393): a, c, t, g, unknown or other
  misc_feature (393)..(393): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (444)..(444): a, c, t, g, unknown or other
  misc_feature (444)..(444): n is a, c, g, or t
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggagtccctgagactctcctgtgaagcctctggattcagcttcagtacgtatggtttgcgctgggtccncaggctccgaggcaagggctgcaggtgggtgcatctatatcatatagaaaggaancaaataaatactacgcaagactcgtagaaggcgatcacatcncagagacaactcccaaagaacactacttanctaganaaatgaacacctganactgagacacggctgtctattatgtgacgaagaggganactcgacncacgacg

SEQ ID NO: 323252 - DNA, 559 bp, Homo sapiens
  misc_feature: GZ8MTXP02HYF4Z.51.6.A06.1.454.CMB.2.raw
  modified_base (216)..(216): a, c, t, g, unknown or other
  misc_feature (216)..(216): n is a, c, g, or t
  modified_base (547)..(547): a, c, t, g, unknown or other
  misc_feature (547)..(547): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacaggacggccaggatcacctgctctgganatgcattcgacccaaccctacttatttcttattcggtaccagcagaagcaggccaggcccctgtgttgtgatataataaagacactgagaggtccttacgagggtactccgtgagcgtattctctcgctccactcgaggacaagtggtcatattcgacatcagtgatccgaggcgaagaagacgaagctagacttattctagtcaaattcttacagtactactcgagttcggttaacttagtacgttcgttacggaacgttacgggaaccgtaagggttccaccggtacgttacggacacgacccgaacggccctaaacccacgtctaccncttcgttccccg

SEQ ID NO: 323253 - DNA, 677 bp, Homo sapiens
  misc_feature: GZ8MTXP02F0P6S.51.6.A06.1.454.CMB.2.raw
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggacgtccctgagctctcctgtgagcctctggattcagcttcagtacgtagttggtttgcgtcgtcgggtccnccgaggctcgaggcgaagggctgcaggtgggtgcatcgtatatacatagtaggaaaggaanacgaaataaaactacgtaaccgacgtaagtaccgtccggtaagggaaaccggggtcccgtaattaccgaaaccctacgttacccgtacccgaaaggaaacgaaaccaaaaccgtacccccgaaaagtaaaccctaaaccttaaaccttttaactaccttacggtaacaaaaacgttccgaaaacctaccccgttaggaacgtaaccgttagggaaccgtacgtaccggtacttacgttaacttaacgtttagttacggtcggtaacggaaggggtaacgggtaagtaaccggtaggtaactaccgaacgaacccgg

SEQ ID NO: 323254 - DNA, 641 bp, Homo sapiens
  misc_feature: GZ8MTXP02IVCCY.51.6.A06.1.454.CMB.2.raw
  modified_base (294)..(294): a, c, t, g, unknown or other
  misc_feature (294)..(294): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtcctgagctctctgtgagcctctggattcagtcttcagtacgtatggttgcgtcgtgggtcccnccgaggctccgaggcaagggctggctaggtgggtgctagtctatactacagttagtaggaaaggtaagctaaaattaaataccgtacgacagtaccttcccggtaggaaacggggccgtaacttaccgaacctactacctacccgaagaacgaacaactacccaaaagaaacctaactactttaatctacgaactaaacgtacgaaaccctacccgtaggaacgtacgttacggaacgggtaaccgtaccggtcgttacggtacctttaagtttacgtttacggtacggtaccggtaaagggtaaacggggaacggtacgttaccgaacgttaccgaacgtaaccgg

SEQ ID NO: 323255 - DNA, 560 bp, Homo sapiens
  misc_feature: GZ8MTXP02GGCJH.51.6.A06.1.454.CMB.2.raw
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (359)..(359): a, c, t, g, unknown or other
  misc_feature (359)..(359): n is a, c, g, or t
  modified_base (453)..(453): a, c, t, g, unknown or other
  misc_feature (453)..(453): n is a, c, g, or t
  modified_base (541)..(541): a, c, t, g, unknown or other
  misc_feature (541)..(541): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctctgtgagcctntggattcagcttcgagtacgtatggttgcgcgtgggtccnccgaggcctccgaggcgaaggggactggcgaggtgggtgcatctatatcatagtagaaacggaancaaataaactacgtaagccaagacctacgtaggaacggcctagtacaaccatcctaccaagaacgaacaactaccgaaagaaccactactttanctagacaaacgtacgaaccacctagacgtaacttggaacggtacacggtctcgtacttagttacgttacgtgacgaaggaggtaacgngtaacgactacgaacgacg

SEQ ID NO: 323256 - DNA, 675 bp, Homo sapiens
  misc_feature: GZ8MTXP02GQTBD.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctcctatgtgctgacacagccaccctcggtgtccgtgtccccaggacagacggccaggactcacctgctcgtggagatgcattcgcccaaacctactattcttattcggtaccagcaagaacgccgaggcccacggtcccctggtgttcgttagaataataagtaaacgacctacgtagacggacggtcccttacgacggggtactcccgtaggacgtcgtactttcctcgtcggtacctcccgaccctcgaacgggaactaagtcggtacctaacgtaacgttacgacctaagtaccgtaggttagggacgttaccgaagggaccgaaaggaaacggtaaccggtacggtacgtaaacggtaactttacgtttacgtacggttactaaaacgtttccgtttaaccaagtacttaacgtaccgttaagggttacgttaacgtttacgttacgttaaccgtttacggaaaccgtttacggggtaaaccgttaaaccgg

SEQ ID NO: 323257 - DNA, 667 bp, Homo sapiens
  misc_feature: GZ8MTXP02IZ8GG.51.6.A06.1.454.CMB.2.raw
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
  modified_base (309)..(309): a, c, t, g, unknown or other
  misc_feature (309)..(309): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtgggggaggcgtggtccaggccgtggggacggtccctggagacctctcctgngaacgcctgtggattcagtcttnagttacgtgttggttgcgcgtgggtccncgagcctcgaggcgaagggctggcgaggtgggtcgcatcgtaatactcaagtataggaaaagaagactaaaaagttaaaactaccgtaaccgactaacggtaacctacccgggtaggaaaccggggtccctaaagttcccaaaccctagtacccgtaccccgaaaggaaccaaaccaaacctaccccgaaaataaacccctaaacttaaaccttttacacttacgaaacccaaaattccgaaaacccgtacccgtaggaaaccgtaacgttacgggaacgtaaccgacgggttccttacgtaactttagttacgttggtacgaggtaaggacggtacagtaccgaacaccgaacgacg

SEQ ID NO: 323258 - DNA, 569 bp, Homo sapiens
  misc_feature: GZ8MTXP02GI3AZ.51.6.A06.1.454.CMB.2.raw
  modified_base (339)..(339): a, c, t, g, unknown or other
  misc_feature (339)..(339): n is a, c, g, or t
  modified_base (456)..(456): a, c, t, g, unknown or other
  misc_feature (456)..(456): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgaagcctctggattcagcttcagtacgtattggtttgcgtcgtgggtccgccaggcctccgaggcaagggctgcaggtgggtgcatctatntcatagtggaaaggagcaaataaatacgtacgacacgacgtccggtaggaaacgggcccgattaccgacctatccctaccgaagaacaacaactacccaaagaaccacttactttanctagaaccaaagtacgaaaccaccttagaacgtacgtggaacgacgtacggattcgtactaagtttagtcggtagacggaagggtagggaatacgtacgaactacgacaacgg

SEQ ID NO: 323259 - DNA, 592 bp, Homo sapiens
  misc_feature: GZ8MTXP02GBDEY.51.6.A06.1.454.CMB.2.raw
  modified_base (189)..(189): a, c, t, g, unknown or other
  misc_feature (189)..(189): n is a, c, g, or t
  modified_base (258)..(258): a, c, t, g, unknown or other
  misc_feature (258)..(258): n is a, c, g, or t
  modified_base (303)..(303): a, c, t, g, unknown or other
  misc_feature (303)..(303): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcaggtcgtgggggagcgtggtccagccgtgggagtccctgagactctctgtgaagccctntggattcagtcttcagttacgtattggttgcgtcgtggggtcccncgaggcctccgaggcaaggggctgcagggtgggtgcatcgtatatcgatagtaggaaagaagcaaaataaaactacctacgcaagtaccgtccggtagaacggggcctattacaccatctaccaggaacaacaaactacccaaaagaacctaactaactttagacctagaacaaatcgaaacctacccgagaacgtaacgtaggaacggaacgtacggtacttacgttacttaacttacgtttcggtaggacggaaggaaggggtacaagttccgataccgaaacgacg

SEQ ID NO: 323260 - DNA, 648 bp, Homo sapiens
  misc_feature: GZ8MTXP02I78WX.51.6.A06.1.454.CMB.2.raw
  modified_base (468)..(468): a, c, t, g, unknown or other
  misc_feature (468)..(468): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgctattcgacccaaacccacttattcttattcggtaccagcaagaagccaggccacggtcccctttgttcgttgatataataaagacactgagacggccttgagggatccctgagcgtattctctggcctccacctcgagggacaagtcggtcaactattcgaaccatacgaggtcgggagtacccgaggacaaaggaaacgacggaaaggcctaggtaactttagttctagtactaaattccttacgtanaacctataccgtagttacggttactttaatcggttactttaccgggaaaacgtacggggtaaacctaaggggttacctacccggttaccggtacggttacccgaacggtaccccgaaaacggaacccccttaaaaccccgacgttacgtaccctaccgtttccttacccgtttacccccc

SEQ ID NO: 323261 - DNA, 617 bp, Homo sapiens
  misc_feature: GZ8MTXP02H8ORD.51.6.A06.1.454.CMB.2.raw
  modified_base (200)..(200): a, c, t, g, unknown or other
  misc_feature (200)..(200): n is a, c, g, or t
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
  modified_base (370)..(370): a, c, t, g, unknown or other
  misc_feature (370)..(370): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctgggtncagtcgtggggggagcgtggtccaggcctgggaggtccctgagctctcctgtgaagcctctggattcagtctcaagtacgtattggttgcgcgtgggtcccncgaggcctccgaggcgaaaggggctgcgtaggnggggtgctagtctatatcatagtaggaaacggaanactaaaattaaaataccgtaacgacaaggtacctcccggtagaaacgggcccgtaattccgaacctacttcctaaccaaggaacgaacctaacaacccaaaacgactaacctaacttttacactagaaactaaacgtacgaaacctacccgtagaacgtacgttaggaacggaacgtaccggtctacgttactacgtttacgttggtacggacggaaaggacgggaatacgtacgactacgacgacg

SEQ ID NO: 323262 - DNA, 583 bp, Homo sapiens
  misc_feature: GZ8MTXP02FJPT9.51.6.A06.1.454.CMB.2.raw
  modified_base (364)..(364): a, c, t, g, unknown or other
  misc_feature (364)..(364): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtgggggaggcgtggtcccaggccgtgggacggtccctgagactctcctgtgaagcctctggattcagtcttcagtacgtagtggtttgcgtcgtcgggtcccgccgaggcctccgaggacgaaggggactggcgagggtgggtgcatctatatcatanagaaaggaagacaaataaaactactacgacaagacctccggtaggaaacgggccgtattaccactactcctaccagaacgaacaactaccccaaagaactaactactttatctagactaaatcgaaaccaccgtgaagactaggaacgacgacgctacgttactattaacgttggtacgacggaaggtagggaacgtacgtaccggaactacacgaacg

SEQ ID NO: 323263 - DNA, 522 bp, Homo sapiens
  misc_feature: GZ8MTXP02FGY82.51.6.A06.1.454.CMB.2.raw
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccccatattcttattggtaccagcagaagccaggccaggccccctgtgttgttgatatataaagacactgagaggcttcagganccctgancgatctctggctccactcaggacaatggtcacattgaccatcagtgagtccgggcagagagagctgactatttctgtcaaatcttcagacatcagtggtacttagtgtcttacggaactgggaaccaaggtcctaccgtccttacggtcaacggccccaaaggccccaaacccctacgtcgtaccacgtcctcgtttacccccc

SEQ ID NO: 323264 - DNA, 591 bp, Homo sapiens
  misc_feature: GZ8MTXP02IPRYG.51.6.A06.1.454.CMB.2.raw
  modified_base (296)..(296): a, c, t, g, unknown or other
  misc_feature (296)..(296): n is a, c, g, or t
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagactctcctgtgaagcctctggattcagcttcagtacgtatggttgcgctgggtccncaggctcaggcaagggctgcaggtgggngcatcatntcatatagaacggaanactaaataaactactacgacagacctacggtaggaacgggaccgtaactaccaccctactcctaccgaagaacgaaaccaaacctaacccaaacgaaacctaaacttaacctttaactacgtacgaaacctaaactacgaacctacccgtagaaccgtacgtaggacggtacgtacggtcgtacgttacttaacgttacgttacgtacggacggaaggaggtacgacgtacgactacgacacg

SEQ ID NO: 323265 - DNA, 639 bp, Homo sapiens
  misc_feature: GZ8MTXP02GGI8Y.51.6.A06.1.454.CMB.2.raw
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggagtccctgagactctcctgtgaagcctntggattcagcttnagtacgtatggttgcgcgtgggccncgaggcctcgaggcaagggctgcaggtgggtgcatctaatctacatagtaggaaaggaagactaaataaatactacgacaagtaccgtaccgtagggaaacgggccgaattaccgaacctacttaccgacccaaagaacgaaacctaaacgtaaccccaaaagtaaacctaaccttaaacttttacaccttaggaaacctaaaagtaccgaaaaccctacccgttaagacgttaacgttacgggaacggtaaccgacggttacgttacgttaacgttaacgtttacgttacggttcggacggtaacggtaacgggacggtattacccgagtaccgacggaacg

SEQ ID NO: 323266 - DNA, 711 bp, Homo sapiens
  misc_feature: GZ8MTXP02I5Q15.51.6.A06.1.454.CMB.2.raw
  modified_base (261)..(261): a, c, t, g, unknown or other
  misc_feature (261)..(261): n is a, c, g, or t
  modified_base (390)..(390): a, c, t, g, unknown or other
  misc_feature (390)..(390): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcggtgggggaggcgtggtccagccgtgggacggtccccgagactctctgtgacgcctntggattcgagtcttacgaggttacgtagtggtttcgcgtcgtcggggtcccgccgagggtcctaccgagggccgaagggctggcgtaggtggggtcgctagtctatactacatagtaggaaacggtaanaactaataaactacgtacgactacgtaccgtaccggtaagggaaccggtccttactacccgactactacccgacgaagaaaccgaactaaccgtaacccaaaacgtaaacctaaccttaactttaccgtacgtaacgaacctaaaacgtacccgaaacccgtaccgtaggtaacgttaacggtaacgggaaccggtaaccgtaccgggttactttacggttaactttaaggtttaacggtacgggtaacggtaacggggtaaaggggtaaccggggtactaacggtaaaccgtaccgtaaccgaaccggaacggtaccccg

SEQ ID NO: 323267 - DNA, 625 bp, Homo sapiens
  misc_feature: GZ8MTXP02H8P2L.51.6.A06.1.454.CMB.2.raw
  modified_base (189)..(189): a, c, t, g, unknown or other
  misc_feature (189)..(189): n is a, c, g, or t
  modified_base (259)..(259): a, c, t, g, unknown or other
  misc_feature (259)..(259): n is a, c, g, or t
  modified_base (480)..(480): a, c, t, g, unknown or other
  misc_feature (480)..(480): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcaggtcgtggggggaggcgtggtccaggccgtgggacgtccctgagctctctgtgagcctntggattcagtcttcagtacgtatggtttgcgtcgtgggtcccgccaggcctccgaggcaaggggctgcgaggtgggtgcatctatatcaatagtaggaaaggaagtcaaaattaaactaccgtaacgcaacggtacctccgggaggtaacgggccgtattccgaaccattcctacccaaggacgaaccaactacccgaaaagtaaccaacttacttttaanaccttaggactaaaacgtcgaaaccctcccgtagtaacgtacttagggaacggtaccgacgggtcttagttaccttaaagttttacgttggtacggtacgggaaacggtaggggaacgtacgttaccggtactaccgaacgacgg

SEQ ID NO: 323268 - DNA, 644 bp, Homo sapiens
  misc_feature: GZ8MTXP02G9DFC.51.6.A06.1.454.CMB.2.raw
  modified_base (190)..(190): a, c, t, g, unknown or other
  misc_feature (190)..(190): n is a, c, g, or t
  modified_base (306)..(306): a, c, t, g, unknown or other
  misc_feature (306)..(306): n is a, c, g, or t
  modified_base (371)..(371): a, c, t, g, unknown or other
  misc_feature (371)..(371): n is a, c, g, or t
tcagcgatcgtatacacgaccggtgctcgatttagatctactgacaggggtctgggagacgagcccagcactggaagtcgccggtgtttccattcggtgatcatcactgaacacagaggactcacatggagtttgggctgagcttgggttttcctcgttgcttcttttaagaggtgtccagtgtcaggtncagctggtgcagtcgtgggggagcgtggtccaggccgtgggacgtcctgacgactctcctgtgaacgccctgtggatcgagtcttacgagttacgtatggttgcgcgtgggtcccncgaggcctccgaggacgaagggctggcgaggtgggtgctagtctatatcatagtagaaaggaaanactaaaataaactacgaacgactaacgtaccgtacggtaagaacggtacctaactaccaacctacgtaccgaaccgaagaacaaacctaaacctaaccgaaaacgtaaacctaaacttaactttacacgtacgaaactaaacgtacgaaaccaaccgtagaacgtaacgtaggaaacggtaacgtacggtacttacgttaactttaacgttacgtacggtacggaacgggtaagggtaacggtaacgtacgtacgtaacgtaaccgaacgacg

SEQ ID NO: 323269 - DNA, 526 bp, Homo sapiens
  misc_feature: GZ8MTXP02I3REK.51.6.A06.1.454.CMB.2.raw
  modified_base (404)..(404): a, c, t, g, unknown or other
  misc_feature (404)..(404): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (511)..(511): a, c, t, g, unknown or other
  misc_feature (511)..(511): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattcgaccaacccactattcttattggtaccagcagagccaggccacggcccctgtgtgttgatatataaagcactgagaggccttgaggactccctgagcgtattctctcggctcccactcgaggtacaagtggtccactatgaccatcaggtgagtccagcagaaagcgaggtcagactattcngtacaatcttanagtanactactaggtagttacttatcggttcttacgggactacgggacaggtcaaccgttccgaggttccacgacccaacggacccaaccctacncgtacacgtcctccg

SEQ ID NO: 323270 - DNA, 650 bp, Homo sapiens
  misc_feature: GZ8MTXP02GL3WB.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgtctcttttaagaggtgtccagtgtcaggtgcagctggtgcaggtcgtgggggagcggtggtccaggccgtggggacgtcctgacgactctcgtgtagacgcctctggattcgagtcttcaggtacgttagtggtttgcgtcgtcggggtccgccgagggcctacgaggacgaaacggggctggcgagggttggggtgctagtctagtatacaatagtaggaaaaggaacacgaaaattaaactaaccgtacgaacaacgtaccgtaccgggtagggaaacggtcccgtacttaccgacctagtccctaccgaagacgaacaaactaacccaaaacgaaccaacttaactttacacttaacgacaaaacgttacgaaaccctacccgtacgaacgtaacgttacgaaccggaacgacggtacttcgtaactttaagttacgttgtaccggaggtaaggacggggtaatacgtacggactaccgagaaccgg

SEQ ID NO: 323271 - DNA, 680 bp, Homo sapiens
  misc_feature: GZ8MTXP02HOK9R.51.6.A06.1.454.CMB.2.raw
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (539)..(539): a, c, t, g, unknown or other
  misc_feature (539)..(539): n is a, c, g, or t
  modified_base (659)..(659): a, c, t, g, unknown or other
  misc_feature (659)..(659): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccaggccgtgggacggtccctgacgactctctgngacgcctntggattcagtcttcagtacgtatggtttgcgtcgtgggtcccgccgaggcctccgaggcgaaggggactggacgagggtcggggtgactagtcttaatactacgtaatagtaggaaaacggaagtacctaaaattaaaacgtaacctaacgtaccaaggaccgttccggtaaagggaacgggacccgtaacttccaaacctacttaccgaacccaaggaacaaacctaaacctaccccgaaaactaaaccctaacttaaccctttttacgaccgtanaaactaaaacgtacgaaaccctaaccccgtagtaaccgtaaccgttaggaaaccggtaccgtaccggtacgttcttaactttagtttacgtaggttcggaacggtaaggagggaagtacncggttacacgtaacgaaccgg

SEQ ID NO: 323272 - DNA, 644 bp, Homo sapiens
  misc_feature: GZ8MTXP02GXBYL.51.6.A06.1.454.CMB.2.raw
  modified_base (297)..(297): a, c, t, g, unknown or other
  misc_feature (297)..(297): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatcacctgctctggagatgcattcgacccaaacccacttatttcttattcggtaaccagacagaagccgaggccacggcccctgtgttgttgatataanaaagacacgtgagaggccttacgaggactcccgtggagtcgtattcctcgtccggcctacccaccgtcgaacggggtaacaaagttcggtaccaacgtacttacgaccctatacgacggttgacgtacccgaggacgaaaggaaagacggaggtactacgtacttaatttcgtagttactaaacttcttaacaagtacctagttacgtaacggttaggttacttaagttcgttacgttacggtaacgttacgggaaccgtaaggtacccgtaccgtaccgtacggtaccaacggtacccgaaacgacccccaaacccgtacgtacgtacctaccttcctttaccccg

SEQ ID NO: 323273 - DNA, 635 bp, Homo sapiens
  misc_feature: GZ8MTXP02GZOJ7.51.6.A06.1.454.CMB.2.raw
  modified_base (308)..(308): a, c, t, g, unknown or other
  misc_feature (308)..(308): n is a, c, g, or t
  modified_base (349)..(349): a, c, t, g, unknown or other
  misc_feature (349)..(349): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggaggcgtggtccagccgtgggacgtccctgagctctcctgtgacgcctcgtggattcagtcttcaggtacgtattggtttgcgcgtcggggtcccncgaggcctacccgaggcgaaaggggctggcgtaggtggggngcattctaatacgtcaatagtagaaaggaagctaaaataaactacgtacgcaagtacctaccggtagaacggggtcccaattccgaacctatcctacccgaagtaacaaccaactacccgaaaagtaacccaacgttaacttttacacttagaaacctaaaactacgaaacccgtaaccgttagaaccgttaaccgtaggaaccggtaaccgtaccggtacttacggtttacttaagtttacgtggtcgtaacggaaggacgggtagtactcgactacgacgaccg

SEQ ID NO: 323274 - DNA, 620 bp, Homo sapiens
  misc_feature: GZ8MTXP02HOIL7.51.6.A06.1.454.CMB.2.raw
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
  modified_base (338)..(338): a, c, t, g, unknown or other
  misc_feature (338)..(338): n is a, c, g, or t
  modified_base (364)..(364): a, c, t, g, unknown or other
  misc_feature (364)..(364): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggaggcgtgggtccaggccgtggggacggtccctgagactctcctgtgaagccctntggattcagtcttcagtacgtntggttgcgcgtgggccncgaggcctccgaggcaagggctgcaggtgggcgnatctatatcaatagtagaaaggtaanactaaaataaaatacctacgacaaggacctacccgggtaggaaacgggccgtaacttaccgaacccttactacctaccaagtaacgaaccaaactaccccaaaagaacctaacttaacttttagacctagaacctaaaacgtcgaaacctacccgtaggaacgtacttaggaacggaaccgtacgggtacttacgttacttagtttacgttggtacggcggtaagggagggagtacgtacgtactacgaaacgtcg

SEQ ID NO: 323275 - DNA, 680 bp, Homo sapiens
  misc_feature: GZ8MTXP02JJR00.51.6.A06.1.454.CMB.2.raw
  modified_base (287)..(287): a, c, t, g, unknown or other
  misc_feature (287)..(287): n is a, c, g, or t
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggaggcgtggtccagccgtgggacggtccctgagactctccgtgtgacgcctcgtggattcgagtcttcgagtacgtnttggttcgcgtcgtcgggtcccgcgaggtcctcgaggcgaaggggctggcgnggtgggtgcatctatactanaatagtacggaaaggaacacgtaaaataaaactacgtaaccgacgtaacggtaaaccgttcccgggtaagggaaacggggtaccctaacgttacccaacccgtacttacccgtacccgaagaaaccgaaacctaaaccgaaccccaaaaggtaaaccctaaacgttaaccttttaacaccgtacgaaacctaaaacgttaccgaaaacctaacccgtagacgtacgtacggaacggtaaccgacggtattacgtacttaagtttacgttagcggtaacggaagggaacgggtagtacggtacgtaacgtaccgaacgtacg

SEQ ID NO: 323276 - DNA, 564 bp, Homo sapiens
  misc_feature: GZ8MTXP02I5ATJ.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtccccaggacagacggccaggatcacctgctctggagatgcattcgaccaacccactattcttattggtaccagcagaagccaggccagccctgtgttgtgatataataaagcactgagaggtccttacgagggtactccctgacgcgtattcgtctggcctcccacctcgaggacaagtggtcactattcgaccatcagtgagtccaggcaagaacgagacgctagaacttagttctagtactaagttcttacagtacatacgagtaggttacttagttcgttactttacgggaacttacggggaacctaaacggtccgtaacccgttcgtaacggtcaacggaccccaaacggcccaaacccacgtctacctacttcttaccc

SEQ ID NO: 323277 - DNA, 617 bp, Homo sapiens
  misc_feature: GZ8MTXP02JB18O.51.6.A06.1.454.CMB.2.raw
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgcattcgacccaaaccctatattcttattggtaccagcagaagccaggccaggcccctgtgttgtgatatataaagacactgagaggtccttacgagggtactccccgtgagcgtattcccgtcgtcggtcctcccacgtcgaacggggactaaagttcgggtaccaaccgtagtttacgaaccctataccgtaggttacgggacgtaccgagggacgaaggaacggtacggaaggtctagtacttagtttcgtagtactaagttcttacaacgactatacgtaggttaggtactttagtcgttacgttacggtaacgttagggaacctaaggttccgaccgttaccgtacggtcaacgtacccgaacggaccccaaacccgcgtcgaccttaccc

SEQ ID NO: 323278 - DNA, 697 bp, Homo sapiens
  misc_feature: GZ8MTXP02JDH71.51.6.A06.1.454.CMB.2.raw
  modified_base (218)..(218): a, c, t, g, unknown or other
  misc_feature (218)..(218): n is a, c, g, or t
  modified_base (286)..(286): a, c, t, g, unknown or other
  misc_feature (286)..(286): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattcgacccaacccattattcttattcggtaccagcagagccaggccagccctgtgtgtgatanataaagcacgtgagtacggcctttacgagggactcccgtagacgcgtatttccccgtcgtcggcccttacccgaacccttcggaacggggacctaaacggtttcggggtaacctaacgtaacgtttacggaaacccctaagttacccggtaaagggttacgggtaaccggttccccggaaaggggtacccgaaaagggaaacgggaaccggtaacggggtacctacgggtaaactttaacgttttccttaggttactaaactttccgttacgaacgtactacgtcgttaagttacggtaatttacgtcgttacgttacggaacgtcgggaaacctacggtacctaccgttaccgtacggtaccaaccggtaccccgaaacggacccccaaaccgtcgtacgtacctacccg

SEQ ID NO: 323279 - DNA, 528 bp, Homo sapiens
  misc_feature: GZ8MTXP02IYNRL.51.6.A06.1.454.CMB.2.raw
  modified_base (296)..(296): a, c, t, g, unknown or other
  misc_feature (296)..(296): n is a, c, g, or t
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtctgggggagcgtggtccagccgtgggagtccctgagactctcctgtgaagccctctggattcagcttcagtacgtatggttgcgctgggtccncaggcctcgaggcaaggggctgcaggtgggtgcagtctaatatcatagtgaaaggaanctaaataaactacacgnagactcgtagaacggcctatcactatctacagacaacacaccaaanaacactactttanactanacaaatacgaacaccgtagagtacgtagacgacacggtctacgtattagttagtacgtgacggaaggagggaacgacgtacgactacacgacg

SEQ ID NO: 323280 - DNA, 584 bp, Homo sapiens
  misc_feature: GZ8MTXP02JO0KJ.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccaggcctggggaggtccctgagctctcctgtgaagcctctggattcagcttcagtacgtatggtttgcgtcgtcgggtccgccgaggcctccgaggcaaggggactggcgaggtggggtgctatctatatcatatgaagagcaaataaatactacgcagactcgtagacggccgatcgacatctaccagagacaactacccaaagaaccaactactttactctagaacaaagtacgaaacccaccgtagaacgtaacctaggaacggtaacgaccgggacttacggtacttaactttaacgttcgttagggtaccggtaaagggaacgggggaagtaaccgtaggtaactacgaacgtaacgg

SEQ ID NO: 323281 - DNA, 660 bp, Homo sapiens
  misc_feature: GZ8MTXP02HYCW9.51.6.A06.1.454.CMB.2.raw
  modified_base (215)..(215): a, c, t, g, unknown or other
  misc_feature (215)..(215): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctggtgtcccgtgtccccaggacagacggccaggatcacctgctctgganatgcattcgaccaacccatatttcttattggtaccagcagaagcaggccaggcccctgtgttgtgatatataaagacactgagaggccttcgagggctcccgtgagcgtacttctcgtcggtcctcccacctacgagggaaccaagttcggtacaactagtttacgaacctagtctaaggttcggacgtacccggaggaccgaaaggaaaggaaccggtaagggtcttacggtacttagtttaccgtagttactaaattcgtttacaacggtaccttattaccgagttaacgggttacctttagttcggttacgtttacgggtaaaacgttacgggtaaccgtaaacgggttaccctaaccgggttaccttacggggtaccaacggaaccccgaaaccggacccctaaacccgtacgtcgttaccgtaccgtttcctttacccgg

SEQ ID NO: 323282 - DNA, 572 bp, Homo sapiens
  misc_feature: GZ8MTXP02INL7X.51.6.A06.1.454.CMB.2.raw
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccaggccgtggggacggtccctggacgacctctcctgtagaacgcctctggattcagtcttcagtacgtattggttgcgtcgtcgggtcccgcgtacggcctccgaggcgaagggactggcgaggtggggtgctagtctatatcatanagaagaananaaataaactacacgacacgacgtcgagacggactactacacactcacaacgaacaaccaaccaaccaaacgaacctaacttaactttacactacaaactaaatacgaaacctacgtagaacgtacgtagaacgtacgacgtattactattagttagtcgtaggaggaaggaggacgtacgtacgacacgacgacg

SEQ ID NO: 323283 - DNA, 636 bp, Homo sapiens
  misc_feature: GZ8MTXP02JUQ3M.51.6.A06.1.454.CMB.2.raw
  modified_base (389)..(389): a, c, t, g, unknown or other
  misc_feature (389)..(389): n is a, c, g, or t
  modified_base (505)..(505): a, c, t, g, unknown or other
  misc_feature (505)..(505): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggagcgtggtccagccgtggggacgtccctgagctctcctgtgaacgcctctggtattcagtcttcagttacgtagttggtttgccgtcgtgggtccgacgaggcctccgaggaccgaaggggactggcgtaggtggggtacgctagttctaatagtacaagttaagtaggaaaggaanactaaaataaaattaccgaacgactaaggaacctccggtaaggaaacgggaccctattaccacctaatcctaccgaagaacgaacaaactacccgaaaagactaaacctactttanactacgaaactaaactacgaaaccctaccgtaggaactacgtaggaaccggaacgtaccgggtattaggtacctttagtttaacgtcggtaggacggaaggtacgggacgtagtacggactacgacgaacg

SEQ ID NO: 323284 - DNA, 742 bp, Homo sapiens
  misc_feature: GZ8MTXP02FW8ZB.51.6.A06.1.454.CMB.2.raw
  modified_base (303)..(303): a, c, t, g, unknown or other
  misc_feature (303)..(303): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtggggagtccctgacgactctcctgtgaacgcctctggattcagtcttcagtacgtattggttgcgtcgtcgggtccnccgaggcctcgaggcgaaggggctggcgtagggtgggtcggctagtctaagtactacaagtagtaggaaagggaacgactaaaataaaaacttaccgtaccgactaacggtaaccgttacccggtaaggggaaaccgggggtcccgtaaactttacccaaaccctactttaccctacccgaaaggaacgaaaccctaaaaccgtaccccaaaaacggaaacctaaccttaaccttttaactaccttacggaaactaaaacttaccggaaaacccctacccgtaagtaaccggtaacgtttacgggaaaaccgggaaccgtaccgggttaccttacggtttaaacctttaaagttttaacggtttacgggaccgggttaacggtaacgggggtaacggggaaagtacgttaaccgaacgttaacccgaaacggaacccgg

SEQ ID NO: 323285 - DNA, 788 bp, Homo sapiens
  misc_feature: GZ8MTXP02JWJ7Y.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctccccctcctcactctctgcacaggctctgaggcctcctatgtgctgacacagcccacccgtggtcgtccgtcgtccccagggacaggacggccaggactccacctgctcgtggagatgcattcgacccaaccctacttacttactttagttacggtaaccagtacaaggtaacgccgtaacggcccgaacggtcccccgttgttcggtttaggttagtaaattaagttaaacttaaaacgacccaaccgttaggaacggtaacgggtccctttacggaacggggtaccttccccggttaggacggttaccggtaaacgtttccgttaccggtccggggttacccttacccccggtaaacccgttacccggaacgggggtaaaccctaaaacgggttcgggttaaccaaacgttaactttaccggaacctaacgttaccggaagggtttacgggaacgttacccgaaagggtaccgaaagggtaaaccggaacggaaacgggttccgtaaggttaacgttaagtttcgtacttaacgtaaaacttctttacgaaacgtaacacgttcgtaacggtttaggttaaccttaagttcggttaccgttacgggtaaacggtttccgggaaaccgtttaaaccgggg

SEQ ID NO: 323286 - DNA, 589 bp, Homo sapiens
  misc_feature: GZ8MTXP02GNCEH.51.6.A06.1.454.CMB.2.raw
  modified_base (191)..(191): a, c, t, g, unknown or other
  misc_feature (191)..(191): n is a, c, g, or t
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
  modified_base (365)..(365): a, c, t, g, unknown or other
  misc_feature (365)..(365): n is a, c, g, or t
  modified_base (490)..(490): a, c, t, g, unknown or other
  misc_feature (490)..(490): n is a, c, g, or t
  modified_base (496)..(496): a, c, t, g, unknown or other
  misc_feature (496)..(496): n is a, c, g, or t
  modified_base (572)..(572): a, c, t, g, unknown or other
  misc_feature (572)..(572): n is a, c, g, or t
  modified_base (578)..(578): a, c, t, g, unknown or other
  misc_feature (578)..(578): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtncagctggtgcagtcgtgggggagcgtggtccagccgtggggagtccctgacgctctctgtgaagcctntggattcagcttcagttacgtattggttgcgtcgtgggtcccncgaggcctccgaggcaagggctggcaggtgggngctagtctatatcaatagtagaaaggtaanactaaaattaaaataccgtaacgacctaaaggtacccttaccggtaaggaaacggggaccctaattaccaaacctattaccaccgaagaacgaacaaactacccaaaagaacctaactactttanacgtanaactaaaagtcgaaacctacctagactacgtagacgaccacggtactacgtattagtactcgagacgaagaggaanacgtanactacacgacg

SEQ ID NO: 323287 - DNA, 613 bp, Homo sapiens
  misc_feature: GZ8MTXP02JJICV.51.6.A06.1.454.CMB.2.raw
  modified_base (311)..(311): a, c, t, g, unknown or other
  misc_feature (311)..(311): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcaggctggtgcaggtcgtgggggaggcgtggtccagccgtgggacggtccctgacgactctcctgtgaagccctgtggattcagtcttcgagttacgtattggttgcgtcgtggggtccccncgaggcctacgaggacgaagggtctggcgtaggtgggtgactatctatactacaataagtaggaaagaacactaaataaactaccgtacgctaacgtaccgtaccggtaaggaacggtacctacgttaccaactactacaccgaagaacaacaaccaccgaaactaacctaacttactttaacactacgaacaaacgtaccgaacctaccgtagaacgtacgtagacgaacgtcgtcttacgtacttagttacgtacgtaggtacggaaggtaggtaacgtacgtacgtacgtacgacgacg

SEQ ID NO: 323288 - DNA, 493 bp, Homo sapiens
  misc_feature: GZ8MTXP02I4C0A.51.6.A06.1.454.CMB.2.raw
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagcagcaggccctgtgtgtgatatataaagacactgagagcttcaggatcctgagcgatctctgctccactcaggacaatgtcacattgaccatcagtgatccaggcagaaagagaggntgactattctgtcaaatcttanananananagtagtatatgtacgtacgtaacgtacgacgaacgtacgacgtacgtacgtacgacgaccgaacgaccaacccactactactactactcg

SEQ ID NO: 323289 - DNA, 639 bp, Homo sapiens
  misc_feature: GZ8MTXP02FUKTL.51.6.A06.1.454.CMB.2.raw
  modified_base (623)..(623): a, c, t, g, unknown or other
  misc_feature (623)..(623): n is a, c, g, or t
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagcccaccctcggtgtccgtgtccccaggacagacggccaggatcacctgctctggagatgctattcgacccaaaccctacttactttctttaagttcggtaaccagacagaacgccaggccacggcccctgtgttgttgataataataaagacactgagacgccgttcgaggactcccgtagacgtcgtattctcgtcggccttacccacgtacgaaggactaagtcggtacaactattacgaccctagtacgtaggttacgggactacccggaaggacgaaacggaaaggaacggaggtacgtagttaccttaagtttctagttacctaaattcccttagacgtaacctatacgtaacgttagttacgttaagttcgtacgtttacggacgtacggacgtacgtccgtaccgtacgtacgtacaccgtaaccgaacggtacccaacccctacgtaccgtacnccgtacctttaccccg

SEQ ID NO: 323290 - DNA, 601 bp, Homo sapiens
  misc_feature: GZ8MTXP02JJEWN.51.6.A06.1.454.CMB.2.raw
  modified_base (311)..(311): a, c, t, g, unknown or other
  misc_feature (311)..(311): n is a, c, g, or t
  modified_base (571)..(571): a, c, t, g, unknown or other
  misc_feature (571)..(571): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccaggccgtggggacggtccctgacgactctcctgtgaacgcctcgtggattcagtcttcagttacgtagtggtttcgcgtcgtcgggtccncgaggcctccgaggcgaagggctgcgaggtgggtgcatctatatcaatagtaggaaaggaagactaaaattaaaactaccgtacgacaacggtacctaccgggaaggtaacgggaccctacttaccgaacctactacctaccgaaagtacaacaaacctacccaaaagaacctactactttacactacgaacaaatacgaaacctaccgagacgtacgtagacgtaacgtacggtcttagtacttaagttcgttcggagnggtaaggaggactagtcgaactcgacgacg

SEQ ID NO: 323291 - DNA, 670 bp, Homo sapiens
  misc_feature: GZ8MTXP02I6G1K.51.6.A06.1.454.CMB.2.raw
  modified_base (296)..(296): a, c, t, g, unknown or other
  misc_feature (296)..(296): n is a, c, g, or t
  modified_base (358)..(358): a, c, t, g, unknown or other
  misc_feature (358)..(358): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggacgtccctgagctctctgtgagcctcgtggatcagtcttcagtacgtatggttgcgtcgtgggtccncgaggcctcgaggcgaagggctgcgaggtgggtgctatctatatcagtagtaggaaaggaanactaaaattaaataccgtaaccgacaaacgtaccgttcccggtaagggaaacgggtcccgtaacttaccgaacctactacctaccgaagaacgtaaccaaaccgttacccgaaaagtaaacctaacttaaacctttttaacgaccgttacgaaacctaaaacttaccgaaaaccctacccgtaaggaacgtaacgttacgggaaacggtaccgaacgggtacttacggttacttaaagtttacgttacggtacggtacgggtaaggggaacggggtaacgtaacggttacgaacgttaccgaacgtaaccgg

SEQ ID NO: 323292 - DNA, 562 bp, Homo sapiens
  misc_feature: GZ8MTXP02J0080.51.6.A06.1.454.CMB.2.raw
  modified_base (308)..(308): a, c, t, g, unknown or other
  misc_feature (308)..(308): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (410)..(410): a, c, t, g, unknown or other
  misc_feature (410)..(410): n is a, c, g, or t
  modified_base (475)..(475): a, c, t, g, unknown or other
  misc_feature (475)..(475): n is a, c, g, or t
  modified_base (503)..(503): a, c, t, g, unknown or other
  misc_feature (503)..(503): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggacggtccctgacgactctcctgtgaacgcctcgtggattcagtcttcagtacgtagttggtttgcgtcgtcgggtcccncgaggcctccgaggcgaagggctggcagggtgggtgctatctatatcatangaaggancaaataaatactacgcaacgtactcgtagaacggcctatccacntccacaagacgaaccaactaccccaaagaaccactaactttagactagaacaaatacgaaacccncgtagacgtactaggacgtaccacggtntacgttacttatttagtcgtaggacggtaaggagggtaacagtaccgataccgacgacg

SEQ ID NO: 323293 - DNA, 641 bp, Homo sapiens
  misc_feature: GZ8MTXP02JJ3F3.51.6.A06.1.454.CMB.2.raw
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
  modified_base (388)..(388): a, c, t, g, unknown or other
  misc_feature (388)..(388): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtggggacgtccctgacgactctcctgtgacgtcctgtggnttcagtcttcgagttacgtatggttncggtctcggggtcccnccgaggcctccgaggcgaacggggtactggacgagggtggggtcgactagttctaatatctaatagacggaaagggaanactaaaagttaaaactaccgtaccgacgaacgtaccgtaccgggtagggaacggacccgtaattcccgacctacgtacctccgaacgaacgtaaccaaactacccaaaacggtaacctaacttaactttactacgtacaaacctaaagtacgaaccctacccgagtacgtacgtaggaacgtaccgtacgtcgtacgttattacgtttagtggtacgaggtaaggagggtatacggactacgtacgacgaacg

SEQ ID NO: 323294 - DNA, 681 bp, Homo sapiens
  misc_feature: GZ8MTXP02JV2HD.51.6.A06.1.454.CMB.2.raw
  modified_base (198)..(198): a, c, t, g, unknown or other
  misc_feature (198)..(198): n is a, c, g, or t
  modified_base (259)..(259): a, c, t, g, unknown or other
  misc_feature (259)..(259): n is a, c, g, or t
  modified_base (388)..(388): a, c, t, g, unknown or other
  misc_feature (388)..(388): n is a, c, g, or t
  modified_base (651)..(651): a, c, t, g, unknown or other
  misc_feature (651)..(651): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtncagtcgtgggggagcgtggtccaggcctggggacgtccctgagactctcctgtgaagcctntggattcagtcttcagtacgtatggtttgcgtcgtgggtcccgccgagggtcctccgagggcaaggggtacctgggacagggtggggtgaccagttctaatactcgaattaagtaggaaaagggtaacncctaaaaattaaaactaccgttaaccggacgtaacggtaacccgttacccgggtaagggaaaccgggggtaccccgtaaatttcccgaaccctaagttaccctacccgaaaggaaaccgaaccaaaaccgtaaccccaaaaagaacctaaacccttacgttttaaccactacgaaacctaaaataccggtaaaaccaccccgttaagaaccgtaacgttagggaacgaccgtacgggtcctaggtacttacttagtcgtaggngaagggaggagtacgcgtaacacgacgacg

SEQ ID NO: 323295 - DNA, 554 bp, Homo sapiens
  misc_feature: GZ8MTXP02GIZNU.51.6.A06.1.454.CMB.2.raw
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
  modified_base (461)..(461): a, c, t, g, unknown or other
  misc_feature (461)..(461): n is a, c, g, or t
  modified_base (502)..(502): a, c, t, g, unknown or other
  misc_feature (502)..(502): n is a, c, g, or t
  modified_base (524)..(524): a, c, t, g, unknown or other
  misc_feature (524)..(524): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggagcgtggtccagcctggggagtccctgagactctcctgtgagcctntggattcagtcttcagtacgtatgggttncgtcgtgggtccnccgaggctccgaggcgaaggggactggcgtaggtggggtggctagttctagtactactatagtaggaaaggaagtacaaataaaactacgtacgcgaagactccgtagaacggccgtatacaccatcctccagaacgacaactccaaagaccactactttanctagacaaactagaaccacctgatactaggacgacgacggnttacgtctatttacgtgtacgnggaaggaggagtagtaccgagtacacgacg

SEQ ID NO: 323296 - DNA, 668 bp, Homo sapiens
  misc_feature: GZ8MTXP02JO95G.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcgaggtcgtgggggagcgtggtccaggccgtggggacgtccctgacgtctctcctgtgaacgtcctcgtggattcgagtcttcagttacgtagttggtttgccgtcgtcggggtcccgccgacggtcctacggaggacgaagggactggcgtagggtggggtcgactagtctagtatactaataagtaggaaaacggaatactaaaattaaataaccgtaacgactaacggtaacctccggtaggtaaacggacccgtaacgttacccacctaactacctaccgaacgaacgaaacctaaactaacccgaaagaaacctaacttaactttactacgttacaaactaacgtaacgaaaccctaccgtagtaacgtaacgttacggaacgtaccgtaccggttcttacgttacttagtttacgtacgtaggacggaaggaggtaacgtacgtacgtacgtaccgacgacg

SEQ ID NO: 323297 - DNA, 636 bp, Homo sapiens
  misc_feature: GZ8MTXP02GI6NQ.51.6.A06.1.454.CMB.2.raw
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaaggaggtgtccagtgtcaggtgcagctggtgcaggtcgtgggggaggcgtggtccaggccgtggggacggtccctgagtacctctcctgtgaacgtcctctggattcgagtcttgagtacgttgttggttcgcggtcgtggggtcccncgnggcctccgaggcgaaggggctggcgagggtgggtgcatctatatacatagtaggaaaggaacactaaaataaactactacgctaacgtaccgtccgtagggaaacgggaccgtacttaccaacctacgtacctaccgaacggaacgaaaccaaacctacccgaaaacgaacctaaacttactttaactacttacgaaactaaacgtacgaaacccaccgtagtacgtacgtacggacggacgtcgtacgtcgttacttagttacgtcgtaggtacggaagggtacgggtagacgtacgaacgtacgaacgtacgg

SEQ ID NO: 323298 - DNA, 547 bp, Homo sapiens
  misc_feature: GZ8MTXP02H9TB0.51.6.A06.1.454.CMB.2.raw
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (440)..(440): a, c, t, g, unknown or other
  misc_feature (440)..(440): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgaagcctctggattcagtcttcagtacgtatggtttgcgtccgtgggtcccgccgtaggcctccgaggcaaagggctgcgagtgggngcagtctatatcatagtcgaaggancaaataaanctacgnagactccgtagaagggcgattcaccatctacagaacgacaactacccaaagaacactaactttanactagactaaatacgaaaccaaccctagaacgtaccgttagaacggtacacggtctagtacttattacgttcgtgtacgaaggaggagacgtacgactcgaacgacg

SEQ ID NO: 323299 - DNA, 638 bp, Homo sapiens
  misc_feature: GZ8MTXP02GMMA3.51.6.A06.1.454.CMB.2.raw
  modified_base (219)..(219): a, c, t, g, unknown or other
  misc_feature (219)..(219): n is a, c, g, or t
  modified_base (261)..(261): a, c, t, g, unknown or other
  misc_feature (261)..(261): n is a, c, g, or t
  modified_base (328)..(328): a, c, t, g, unknown or other
  misc_feature (328)..(328): n is a, c, g, or t
  modified_base (389)..(389): a, c, t, g, unknown or other
  misc_feature (389)..(389): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtgganatgctattcgacccaaaccctattattcttattggtaccagnagacgccacggccacggccctgtgttgtgataatataaagacatgagacggtccttgaggctcccgngagcgtattcctcgtgcctaccacctcgacgggactaagtcggtacactagttcgaaaccngtacgagtcggacgtacccgagggaaccgaaggaaacgaacgggacggtactaacggtactttaaacgtttctacggtactaaattcttacgaagtaacctatcgtaaggtttcggttaaacttgttacggttacgtttacggaaaacggttcgggtaaacctaaacggggtaccctaccggttacctaggttaccgaacgaccccgaaacggaccccctaaacccgtacgttaccgtaccttaacccg

SEQ ID NO: 323300 - DNA, 557 bp, Homo sapiens
  misc_feature: GZ8MTXP02F8DVY.51.6.A06.1.454.CMB.2.raw
  modified_base (425)..(425): a, c, t, g, unknown or other
  misc_feature (425)..(425): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgcccaacccatattcttattggtaccagcagagccaggccaggcccctgtgttgtgatatataaagacactgagaggccttacgagggatcccgtgagacgtattccctctcggctccacctcgagggacaagtggtacacgtattcgacctatcgagtggagtccgaggcgaagaagacgaggctagtacttatttcngtactaattcttacagactatcgtagttggtacttagtgttactacggtaactcgggaaccgtaaacggtcctaccgtccgtacggtacaacggtacccgaacggaccccaaacccgactcgtacctacccg

SEQ ID NO: 323301 - DNA, 533 bp, Homo sapiens
  misc_feature: GZ8MTXP02GORKB.51.6.A06.1.454.CMB.2.raw
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (445)..(445): a, c, t, g, unknown or other
  misc_feature (445)..(445): n is a, c, g, or t
  modified_base (467)..(467): a, c, t, g, unknown or other
  misc_feature (467)..(467): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtgaagcctctggattcagcttcagtacgtatggtttgcgctgggtccgccaggctcaggcaaagggactgcagtgggtgcatctatatcatatagaaaggaaananaaataaataactacgacagactacgtagaaggacgactacacactactacacgaacgaacaaacaaccaaacaaacaactaacttaatactanacaaataacaacaacctacganactacgagaacgacgacgtacgtatacttacttagtagacgaagaggagacgtacgactacacacg

SEQ ID NO: 323302 - DNA, 592 bp, Homo sapiens
  misc_feature: GZ8MTXP02GIH85.51.6.A06.1.454.CMB.2.raw
  modified_base (450)..(450): a, c, t, g, unknown or other
  misc_feature (450)..(450): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaacccacttattcttattcggtacagcagagccagccaggccctgtgttgtgatataataaaagacacgtgagagtccttcgagggactcccgtgacgcgattctcgtcggcctccactacgagggaactaagtggtacagtattacgaacctatccgaagtggacgtccaagggacagaaagacgagactagacttagttctagtacaaacttcgttaanacgtactatacgtaggttacgttaactttacgtcggttacgttacggaaacggtacggaaccgtaacggtccgtaaccgttacgtacgacgaaccgaacccgaaccgaccccaaaccctactccgtactaccgttcgtcccg

SEQ ID NO: 323303 - DNA, 674 bp, Homo sapiens
  misc_feature: GZ8MTXP02HJC5Q.51.6.A06.1.454.CMB.2.raw
  modified_base (190)..(190): a, c, t, g, unknown or other
  misc_feature (190)..(190): n is a, c, g, or t
  modified_base (309)..(309): a, c, t, g, unknown or other
  misc_feature (309)..(309): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcagggtncagctggtgcagtcgtgggggaggcgtggtccagcctggggaggtccctgagactctcctgtgaacgcctctggattcagtcttacagttacgtattggtttgcgtcgtcggggtcccnccgtaggcctacggaaggaccgaaaggggctgggacgaggttggggtcggactagttctaatacgtcaagttagtaggaaaggaacactaaaataaataccgtacgactaaggaccttaccggtaggaaacggggcccgtaattccaaccctataccctaccgaagaacgaaccaaaactacccccgaaaagaaaccctaacttaaccgttttaatacctacggtaaactaaaacgttacgaaaccctaaccccgttagaaacggtaccgttagggaaacggtaccacgggtccttaggtacttactttaacgtcggtacggacggtaaagggtagggaacgtacgtacggaacacgaaccgacg

SEQ ID NO: 323304 - DNA, 656 bp, Homo sapiens
  misc_feature: GZ8MTXP02JYZTJ.51.6.A06.1.454.CMB.2.raw
  modified_base (156)..(156): a, c, t, g, unknown or other
  misc_feature (156)..(156): n is a, c, g, or t
  modified_base (175)..(175): a, c, t, g, unknown or other
  misc_feature (175)..(175): n is a, c, g, or t
  modified_base (205)..(205): a, c, t, g, unknown or other
  misc_feature (205)..(205): n is a, c, g, or t
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (616)..(616): a, c, t, g, unknown or other
  misc_feature (616)..(616): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttccncgttgctcttttaagagtntccagtgtcaggtgcagctggtgcaggtcngggggagcgtggtccaggcctggggagtccctgagactctcctgtgacgcctngattcagtcttcagtacgtntggtttgcgntggggcccncaggcnccgaggcaagggctggcgtagggtgggtgctattctaatatacataagtaggaaagaagactaaaattaaactccgtacgacaggtaccgtcgggtagggaaaccggggtacctaacttcccaacctaacgttaccctaaccgaaaggaaacgtaaccaaaaccgttaaccccaaaaacgtaaacccttaaaccttaacttttaactaccggtaacgaaccaaaacgtaccgaaaaccctacccgtaagaacggttaacgttacgaaacggggtaacctacggtactttacgttacttaagtttacgttcggnggaacggaaggaacggggaactactacgactacaacgacg

SEQ ID NO: 323305 - DNA, 560 bp, Homo sapiens
  misc_feature: GZ8MTXP02H5Z66.51.6.A06.1.454.CMB.2.raw
  modified_base (237)..(237): a, c, t, g, unknown or other
  misc_feature (237)..(237): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtgcagtctgggggatgcgtggtccagcctgggagtcccngagactctcctgtgaagcctctggattcagcttcagtacgtatggtttgcgctcgggtccgcaggcctccgaggcgaagggactgcaggtgggtgcatcctatatcaatatgaagagacaaataaactacaacgcaagacctaccgtagaaacggggccctaattcccaaccctagttcccacaagaaccacaaactaccaaaacaaactacttaactttacgactacaaccaaagtaccaactacccgtagaacgtacttaacggacgacgtacggtctagtacttagttagttgacgaagaaggaggacagtcgatacgag

SEQ ID NO: 323306 - DNA, 559 bp, Homo sapiens
  misc_feature: GZ8MTXP02FI59R.51.6.A06.1.454.CMB.2.raw
  modified_base (254)..(254): a, c, t, g, unknown or other
  misc_feature (254)..(254): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (349)..(349): a, c, t, g, unknown or other
  misc_feature (349)..(349): n is a, c, g, or t
  modified_base (430)..(430): a, c, t, g, unknown or other
  misc_feature (430)..(430): n is a, c, g, or t
  modified_base (511)..(511): a, c, t, g, unknown or other
  misc_feature (511)..(511): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctctgtgagcctntggattcagcttcagtacgtatggtttgcgntgggtcccncaggctccgaggcaaggggctgcaggtgggtgcatctatatcatagtagaaggancaaataaatctacgcagactccgtagaacgggccattacgaccagtcaccagacgacaactcccaaagaccactactttanctagactaaacgtcgaaccaccctggaacgtacttaggaacggacctacgggtcttacggtccttaaagtttacttacggnggtaccggaagggacggggaagtacttaccggaataccgacgtaacgg

SEQ ID NO: 323307 - DNA, 521 bp, Homo sapiens
  misc_feature: GZ8MTXP02FUIVI.51.6.A06.1.454.CMB.2.raw
  modified_base (253)..(253): a, c, t, g, unknown or other
  misc_feature (253)..(253): n is a, c, g, or t
  modified_base (367)..(367): a, c, t, g, unknown or other
  misc_feature (367)..(367): n is a, c, g, or t
  modified_base (455)..(455): a, c, t, g, unknown or other
  misc_feature (455)..(455): n is a, c, g, or t
tcagcgatcgtatacacgaccggtgctcgatttagatctactgacagggcacgaccggtgctcgatttagatctactgacaaggggctgtgggtccaggaggcagaactctgggtgtctcaccatggcctggatccctctacttctccccctctcactctctgcacaggctctgaggcctcctatgtgctgacacagccaccctggtgtcccgtgtcccccaggacagacggccaggatcacctgctctgganatgcattgccaacccatattcttatggtaccagcagaagccaggccaggcccctgtgttgtgatataataaagccactgagtaggccttcgagggctccctgagcgtattctcnggctccacctcgaagggacaaatggtacaatattgacctattaccgaagtggacgtccgaggacagaagacgaggctgacttattcgntacaattcctacagtactatcgtagtgtaagttagtcgttacgtacgtaacgtacggaacgtaacg

SEQ ID NO: 323308 - DNA, 649 bp, Homo sapiens
  misc_feature: GZ8MTXP02HQZY7.51.6.A06.1.454.CMB.2.raw
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccacctcggtcgtccgtgtccccaggacagacggccaggatcacctgctctggagatgcattgccaacccnctattcttatgtacagnagancagcagccctgtgtgttgatatataaagaccactgagaggtcttacgagggactcccgtgagtcgtattctctcggccttaccacctcgacgggacaaagtcggtacactacttcgacctactaccgtaaggtcggtaacgttacccgaagggcgaaacggaaacggaaccggaacgggtacccgtacgggtaaaccctttagtttttaccgggttacgttaaaccgttaaaacgtttcctttaaaccccgaaaggttaaccgaacttacgttaaccggttaggtttaaacctttacgttacgtttacccggtttaaccggtaaaccggttacggggtaaaccgtttaaaacccgggg

SEQ ID NO: 323309 - DNA, 608 bp, Homo sapiens
  misc_feature: GZ8MTXP02FLOX9.51.6.A06.1.454.CMB.2.raw
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgagcctntggattcagcttcagtacgtatggtttgcgcgtgggtccncaggctcaggcaagggctgcaggtgggtgcagtctatatcatagtaggaaaggaagcaaataaatactacgacaagactccgtagaaacgggcccgtattccaaccatacctacccgaagaacgaaccaaacgtaccccaaaagtaaccaacctaacctttatacctacgaactaaaactcgaaacctacccctagaacgtaaccgtggaacggaacaccgggtcttacggttacttaaagtttacgttacgtagggaccggtaaggggaacgggggtaagtaacgttacggaaactccgaaccgaaaccgg

SEQ ID NO: 323310 - DNA, 731 bp, Homo sapiens
  misc_feature: GZ8MTXP02H1WYT.51.6.A06.1.454.CMB.2.raw
  modified_base (713)..(713): a, c, t, g, unknown or other
  misc_feature (713)..(713): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggagcgtggtccagccgtggggacgtccctggagactctccgtgtagaacgcctctgggtattcacggtcttcgaaggttacgtagttgggtttcgcggtccggttggggtccccgccgtacgggcctcccggaagggaccgtaaagggggaccttgggccggtaggggttgggggtacggcctaagttaccttaataactccgaaagttaggtacggaaaaggtaaacgactaaaaaatttaaaacgtaccgtaacgaaccaacggtacccttacggaaacgggtaaacgggggcccttaaacttacccgaaaccacgtttaccgaaccccgaaagggaaacaaacccaaacttaaacccccgaaaagtaaaaccctaaacctttaaactttttacgaacctaacggaaacctaaaataccggaaaaccctacccgtaggaaacgtaccgtagaaacgtacaacggttctagtacttagttacgtggcaagggaagagganacgtcacgtacacgaacg

SEQ ID NO: 323311 - DNA, 545 bp, Homo sapiens
  misc_feature: GZ8MTXP02I7VXE.51.6.A06.1.454.CMB.2.raw
  modified_base (475)..(475): a, c, t, g, unknown or other
  misc_feature (475)..(475): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtgtccccaggacaggacggccaggatcacctgctctggagatgcattcgacccaaacccattattcttattcggtaccagcagacgccaggccaggcccctgtgttgtgatatataaagaccactgagagtccttacgagggctcccgtgacgcgtattcgtcgtggcctccacctacgagggactaagtgtaccaacgtattacgacctatacgagtggacgtcgaggacgaagaagacgagtcgtagacttatttcgngtactaattcttcaagtacagtacagttaggtaacttagtcgttcgttacggaacgtcggaacctaacgg

SEQ ID NO: 323312 - DNA, 529 bp, Homo sapiens
  misc_feature: GZ8MTXP02IMGI1.51.6.A06.1.454.CMB.2.raw
  modified_base (318)..(318): a, c, t, g, unknown or other
  misc_feature (318)..(318): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
  modified_base (467)..(467): a, c, t, g, unknown or other
  misc_feature (467)..(467): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (499)..(499): a, c, t, g, unknown or other
  misc_feature (499)..(499): n is a, c, g, or t
  modified_base (524)..(524): a, c, t, g, unknown or other
  misc_feature (524)..(524): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggagcgtggtccagcctggggacgtccctgacgactctccgtgtagaacgtccctcgtggtattcagtcttacaggttacgtagtggtttcgcgtcgtggggtcccncgaggcctcgaggcaagggctgcgaggtgggngcatctatatanatagtagaagganctaaataaatacacgacagactcgagacggctatcacatccacanacacacaccaaanacactactttanactagacaatcaacacctaganacgtgaacgacncgtntcgtacttatcgtcgngagtaaggaggaacgctacgctacncgacg

SEQ ID NO: 323313 - DNA, 609 bp, Homo sapiens
  misc_feature: GZ8MTXP02IWUVL.51.6.A06.1.454.CMB.2.raw
  modified_base (364)..(364): a, c, t, g, unknown or other
  misc_feature (364)..(364): n is a, c, g, or t
  modified_base (472)..(472): a, c, t, g, unknown or other
  misc_feature (472)..(472): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggagtccctgagctctcctgtgaagcctgtggattcagtcttcagtacgtagttggtttgccgtcgtgggtcccgcgaggcctccgaggcaaggggctgcgaggtgggtgctatctatatcatagtagaaaggaanctaaaataaactacctacgacaagtaccgtcgtaggaacgggccctattaccaacctatacctaccgaagtaacgaacaaactacccaaaagaacctaactactttancctagaacaaatcgaaaccctaccgtagaacgtacgttaggaacggtaaccacgggtacttaggttacttaagtttagttacggtacgacgggtaaggaacgggaacggtacgttacggaacttaccgaacgtacgg

SEQ ID NO: 323314 - DNA, 558 bp, Homo sapiens
  misc_feature: GZ8MTXP02JKJ2N.51.6.A06.1.454.CMB.2.raw
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
  modified_base (428)..(428): a, c, t, g, unknown or other
  misc_feature (428)..(428): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggaggtccctgacgactctcctgtgaagcctcnggattcagcttnagtacgtatggttgcgcgtggggccncaggctccgaggcaaggggactggcgaggttggggngcatctatatcatatgaaaggancaaataaatcagnagctcgtagaggcatcacatcnccagacgaactaacaccaaagaacctactactttanactgaacaaagtacgaactacctagacgtactagaacggacgtacgggacctaggttaccttaagtttaacgtttcggacggtacgaagggtaagggggtaactagggttaccaaggtaccaacgaccgg

SEQ ID NO: 323315 - DNA, 676 bp, Homo sapiens
  misc_feature: GZ8MTXP02GBTTN.51.6.A06.1.454.CMB.2.raw
  modified_base (155)..(155): a, c, t, g, unknown or other
  misc_feature (155)..(155): n is a, c, g, or t
  modified_base (319)..(319): a, c, t, g, unknown or other
  misc_feature (319)..(319): n is a, c, g, or t
  modified_base (626)..(626): a, c, t, g, unknown or other
  misc_feature (626)..(626): n is a, c, g, or t
  modified_base (645)..(645): a, c, t, g, unknown or other
  misc_feature (645)..(645): n is a, c, g, or t
  modified_base (660)..(660): a, c, t, g, unknown or other
  misc_feature (660)..(660): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttccncgttgctcttttaagaggtgtccagtgtcaggtgcagctggtgcagtcgtgggggagcgtggtccagccgtggggacgtccctgacgtctctccgtgtagaacgcccttcgtggacttcagtcttacgaggttacgtattgggtttcgcgtcgtcggggtcccncgaagggcctacgaggtacgaaggggtactggcgagggttcgggtaggctaagtctaatacgtcaaagttacgtagggaaaacgggtaactactaaaaattaaaaccgttaaaccgtaccggaacctaaacggtaacccgttacccggtaaagggaaaccggggcccttaaattaccccaaaccgtatacccgtaccgaaacgaacgaacctaaaacgtccccaaaaagaaccctacgtaactttacacgttacgaaactaaaacgtcgaaacctaccgtagaacgtacgtaggaacgacgacggtntacgtactaattacttggngacgaaggacggtanacgtcgaatccagacg

SEQ ID NO: 323316 - DNA, 553 bp, Homo sapiens
  misc_feature: GZ8MTXP02HFASA.51.6.A06.1.454.CMB.2.raw
  modified_base (254)..(254): a, c, t, g, unknown or other
  misc_feature (254)..(254): n is a, c, g, or t
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (441)..(441): a, c, t, g, unknown or other
  misc_feature (441)..(441): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggacgtcctgagactctctgtgagcctnggattcagtcttcagtacgtagtggtttgcgtcgtgggtcccgccgaggcctaccgaggcgaagggctggcgaggtgggtgcatctatatnatagtagaaaggaancaaataaatactacgacagacgtcgagaggccgtatacaccatccacgagacgaacactacccaaagaactactactttanactacgaactaaagtaccgaactacccgtagacgtacgttagaacggacgtacggtcttagtacttagttagttcgaggacgaagggtaaggagactacggactacacgacg

SEQ ID NO: 323317 - DNA, 617 bp, Homo sapiens
  misc_feature: GZ8MTXP02JXLP6.51.6.A06.1.454.CMB.2.raw
  modified_base (315)..(315): a, c, t, g, unknown or other
  misc_feature (315)..(315): n is a, c, g, or t
  modified_base (352)..(352): a, c, t, g, unknown or other
  misc_feature (352)..(352): n is a, c, g, or t
  modified_base (388)..(388): a, c, t, g, unknown or other
  misc_feature (388)..(388): n is a, c, g, or t
  modified_base (491)..(491): a, c, t, g, unknown or other
  misc_feature (491)..(491): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcggtgggggaggcgtggtccgaggccgtggggacggtccctgacgtactctccgtgtgacgcctctggattcagtcttcagtacgtattggtttcgcgtcgtcggggtcccnccgaggcctccgaggcgaagggcctgcgaggtggggngctagtctaagtactcgtaatagtagaaaggtaaanactaaaataaactactacgacaacgtaccgtacggaggacggtacctactaccactactccacgaagaacaacctaaccaaccaaacaacctaacttacttanactacgaaactaaacgtaccgaaaccctacgtagtaacgtacgtacggaacgtaccgtacgtcttacgtacttaagttacgtcggtacgacggtaagggacggacgtacgtacgacgtacgacgcg

SEQ ID NO: 323318 - DNA, 525 bp, Homo sapiens
  misc_feature: GZ8MTXP02JCXKD.51.6.A06.1.454.CMB.2.raw
  modified_base (298)..(298): a, c, t, g, unknown or other
  misc_feature (298)..(298): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagactctcctgtgagcctctggattcagcttcagtacgtatggtttgcgtcgtggggtcccncgaggcctccgaggcaaggggctggcaggtggggtgcatctatancatatgaaaggancaaataaatcacgcagactcgagacgggccatcacatctacagacgacaactccaaagaacactactttagctagacaaatcgaaaccacccgtagacgtacgtaggaacgacgacggcttgtacttattattcgagcggtaaggaggggacagtcgaatccgacgacg

SEQ ID NO: 323319 - DNA, 507 bp, Homo sapiens
  misc_feature: GZ8MTXP02FHRBC.51.6.A06.1.454.CMB.2.raw
  modified_base (257)..(257): a, c, t, g, unknown or other
  misc_feature (257)..(257): n is a, c, g, or t
  modified_base (388)..(388): a, c, t, g, unknown or other
  misc_feature (388)..(388): n is a, c, g, or t
  modified_base (418)..(418): a, c, t, g, unknown or other
  misc_feature (418)..(418): n is a, c, g, or t
  modified_base (479)..(479): a, c, t, g, unknown or other
  misc_feature (479)..(479): n is a, c, g, or t
  modified_base (492)..(492): a, c, t, g, unknown or other
  misc_feature (492)..(492): n is a, c, g, or t
  modified_base (500)..(500): a, c, t, g, unknown or other
  misc_feature (500)..(500): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggaggtccctgagactctcctgtgagcctnggattcagcttcagtacgtatggtttgcgctgggtccgcaggctccgaggcaagggctgcaggtgggtgcatctatatcatatagaaggaagcaaataaatactagcagactcgtagaaggcatcacatcnccagagacaatcccaaagaacactacttanctagacaaatcgaaaccacccgtagacgacttaggacgacacggctagtactattagttgngacgaaggagganacgtcganacacacg

SEQ ID NO: 323320 - DNA, 577 bp, Homo sapiens
  misc_feature: GZ8MTXP02JTTQC.51.6.A06.1.454.CMB.2.raw
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctcctatgtgctgacacagccaccctcggtgtccgtcgtccccaggacagacggccaggntcacctgctcgtgganatgctattcgccaacccactattcttattgtaccagcagagccaggccacggcccctgtcgttgtgatatataaagacactgagacgcttgaggntccgngacgcgacttcgtctggcctacccacctacgacggggacagtggtcacctattacgaccagtaccgagttgggaacgtccgaaggcgaacgaaagtaccggaggccgtaggtacttagtttcgtagttccaaatttctacgacggaactactaccgtagtttaggtaacctttagtacggttaccgttacggaaaccgtttaccggggaaccgttaaaccggg

SEQ ID NO: 323321 - DNA, 675 bp, Homo sapiens
  misc_feature: GZ8MTXP02GY77A.51.6.A06.1.454.CMB.2.raw
  modified_base (261)..(261): a, c, t, g, unknown or other
  misc_feature (261)..(261): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtgggggagcgtggtccagccgtgggacgtccctgacgctctcctgtgaacgcctntggattcagtcttcagtacgtagtggtttgcgtcgtcgggtcccgccgaggcctccgaggaccgaaaggggctggcgtagggtgggtgctagttctaatatcaattaagtaggaaaaggaagactaaaattaaactaccgtacgacgaacggtaccgttaccgggtaaggaaacggggaccctaattacccgaaccctacttacccgtacccgaaagaaccgaaacctaaaccgtaaccccgaaaagtaaacccctaaacgttaacctttaataccttaacgaaacctaaaacgtaccgaaaccctacccgtaggtaacgtaacgttaggaacggtaccacggtcttacgttacttagtttagtacggtaggacggtaaggaaggggtactaactacggtactacgaacgaccg

SEQ ID NO: 323322 - DNA, 639 bp, Homo sapiens
  misc_feature: GZ8MTXP02F3DT0.51.6.A06.1.454.CMB.2.raw
  modified_base (262)..(262): a, c, t, g, unknown or other
  misc_feature (262)..(262): n is a, c, g, or t
  modified_base (502)..(502): a, c, t, g, unknown or other
  misc_feature (502)..(502): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagccgtggggacggtccctgacgactctcctgtgaagcctntggattcagtcttcagtacgtattggttgcgcgtgggtcccgcgagctccgaggcgaagggactggcagggtgggtcggactatcgtatactcaatacgtagaaaggaagactaaaataaaactacgtaccgcgtaacgaccgtaccggtaggggaaacgggtcccgtaattacccgaacctactaccctaccgaagaacgaaccaaaaccgtacccaaaagaaaccctactaactttanacctagaactaaaactcgaaaccctacccgtaggaacgtacgttacggaacggtaccgtaccgggtcttacgtttacgttaaagtttacgtttggacggaggtaaggaggggataacgtacggtacaccgaacgacg

SEQ ID NO: 323323 - DNA, 654 bp, Homo sapiens
  misc_feature: GZ8MTXP02F2B01.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagactctcctgtgagcctctggattcagtcttcagttacgtagtggtttgcgtcgtgggtcccgccgaggcctccgaggcaaggggcctggcgaggtgggtgctatctatatctaatataggaaaggaagctaaaataaaatacctaacgactaaggaccttaccggtaggaaacggggtcccgtaattacccaaccctactacctacccgaagaacgtaaccaaacctaccccgaaaacgtaaaccaaccttaactttaactaccttaacgaactaaaaacgtacgaaaacccaccccgttaaggaacgtaacgttacggaacggtaacgtacgggctttacggttaccttaacgtttacgtttagtcggtaaggaagggaagggtaagtacgtacggtaactaccgaacgaacgg

SEQ ID NO: 323324 - DNA, 581 bp, Homo sapiens
  misc_feature: GZ8MTXP02HXXVU.51.6.A06.1.454.CMB.2.raw
  modified_base (189)..(189): a, c, t, g, unknown or other
  misc_feature (189)..(189): n is a, c, g, or t
  modified_base (564)..(564): a, c, t, g, unknown or other
  misc_feature (564)..(564): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcagtcgtgggggagcgtggtccagcctggggagtcctgagactctcctgtgaacgcctctggattcagtcttcagtacgtatggtttgcgtcgtgggtcccgccgaggcctccgaggcgaaggggactggcgaggtggggtgacatctatatcaatagtaggaaaggtaagacaaattaaaataccgtacgacaacggaaccttcccggtaggtaacgggacccgtattaccacctatcctaccgagacgacaactaccaaagaacctaactactttacactacgactaaatacgaaactacccgtagaacgtacgtaggaacgacgacggtctagtacttattacgtgtacgaggtaagaggganacgtcgactacacgacg

SEQ ID NO: 323325 - DNA, 560 bp, Homo sapiens
  misc_feature: GZ8MTXP02FP8JL.51.6.A06.1.454.CMB.2.raw
  modified_base (200)..(200): a, c, t, g, unknown or other
  misc_feature (200)..(200): n is a, c, g, or t
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagttttgggctgagctggggtttttcctcgttgctcttttaagaggtgtccagtgtcaggtgcagctgtncagtctgggggagcgtggtccagcctgggagtccctgagactctcctgtgaagcctctggattcagcttnagtacgtatggtttgcgntggggtcccncaggctcgaggcaaggactgcaggtgggtgcatctatatcatagtagaagaagcaaataaactctacgcagactcgtagaacgggccgattcacatcctaccaagacgacaaactacccaaagaaccaactactttatctagacaaaactacgaaaccctaacccgtagaacgtacgttagaacggaaccgacggcttacgttacttaatttacgtttcgtagacggaaggaaggggaagtacgtacgaactaccaacaacg

SEQ ID NO: 323326 - DNA, 691 bp, Homo sapiens
  misc_feature: GZ8MTXP02HQXMR.51.6.A06.1.454.CMB.2.raw
  modified_base (191)..(191): a, c, t, g, unknown or other
  misc_feature (191)..(191): n is a, c, g, or t
  modified_base (386)..(386): a, c, t, g, unknown or other
  misc_feature (386)..(386): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtncagctggtgcagtcgtgggggagcgtggtccagccgtgggacgtccctggacgtactctcctgtgaacgtccctcgtggattcagtcttcgagttacgtatggttgcgtcgtgggtcccgccgaggcctccgaggacgaaaggggcctggcgtaggtgggtcgacagtctaagtatcaagtagtaggaaaagganactaaaagtaaaactccgtaacgacaacgtaccgttccggagtaaaccggggacctaacgttacccaaccctactaccgtacccaaagggtaacgaaaccaaacgtaacccccaaaagtaaaccctaaaccttaaactttttaacgacttacgaaaccttaaaagtaccggaaaaccctaccccgttaggaaccgtaacgttaggaaccggtaacgtaccgggtacctacgttacgttaactttacgttggtaccggacggtaaggtaggggaacgtagttaccggacttaacggaaaccgacgg

SEQ ID NO: 323327 - DNA, 769 bp, Homo sapiens
  misc_feature: GZ8MTXP02GV8IX.51.6.A06.1.454.CMB.2.raw
  modified_base (256)..(256): a, c, t, g, unknown or other
  misc_feature (256)..(256): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggagtccctgagctctctgtgacgcctntggattcagtcttcagttacgtatgggtttgcgtcgtgggtcccgcgtaggcctccgaggacgaaaggggctggcgtaggtggggtcgcattctaatagtaccaattaagtaggaaaaggtaacgactaaaattaaactaccgtacgactaaggacccttaccggtaggaacggggtaccctaacttacccgaacctaacgttcccgtaacccgtaaggaaccgaaaccgttaaacccgtaacccctaaaaacgaaacctaaacccttaaacctttttaacgaccctttaacggaaaaccctaaaaacgttaccggaaaaacccccttaaccccggttaaaggaaaaccgggttaaccgtttaacggggaacccgggttaaaccgtaaccccggggtttacgtttaaccggtttaacgttttaaacggttttacgggttacgggttaacgggtaacgggtaaaggggtaacggggtaacggtacgtaaccggtaccgtaaccgaacggtacgg

SEQ ID NO: 323328 - DNA, 575 bp, Homo sapiens
  misc_feature: GZ8MTXP02IX62F.51.6.A06.1.454.CMB.2.raw
  modified_base (310)..(310): a, c, t, g, unknown or other
  misc_feature (310)..(310): n is a, c, g, or t
  modified_base (354)..(354): a, c, t, g, unknown or other
  misc_feature (354)..(354): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
  modified_base (538)..(538): a, c, t, g, unknown or other
  misc_feature (538)..(538): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtgcaggtcgtgggggagcgtggtccaggccgtgggagtccctgacgtactctcctgtgaacgccctcgtggattcagcttacagttacgtattggttgccgcgtggggtcccnccgaggcctccgaggcgaagggctgcgaggtgggtgcatctatntcatatggaaagagctaaataaatactacgcaagacctcgtagacggccctatacgacntacnccagacgaacaacnccaaagaactactacttatcagacaaactcggaaactccaagacgtacgtagacggacgtacggtcttacgttaccttaattacgttaggacggttacggaaagggnggggtaaagacgtaccggtaactaccgaagtaaccgg

SEQ ID NO: 323329 - DNA, 593 bp, Homo sapiens
  misc_feature: GZ8MTXP02FR58M.51.6.A06.1.454.CMB.2.raw
  modified_base (259)..(259): a, c, t, g, unknown or other
  misc_feature (259)..(259): n is a, c, g, or t
  modified_base (305)..(305): a, c, t, g, unknown or other
  misc_feature (305)..(305): n is a, c, g, or t
  modified_base (469)..(469): a, c, t, g, unknown or other
  misc_feature (469)..(469): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtgcaggtcgtgggggagcgtggtccagccgtgggagtccctgagactctctgtgacgccctntggattcagtcttcgagtacgtattggttgcgtcgtcggggtcccnccgtaggcctacccgaggacaaaggggctggcgtaggtgggtgctatctaatagtcatagtaggaaaaggaacactaaaataaatacgacgaccaagtaccgtccgtaaggaacgggccctaattaccacattaccaccaaggaacaacaaaccacccaaaaanaacctaacttactttagactacgaaactaaacgtacgaaacctaccgtaagacgtacgtagaacgacgtacgtactcgtacttattagtcgtagaggaaggaggagtacgtagactacgacgcg

SEQ ID NO: 323330 - DNA, 636 bp, Homo sapiens
  misc_feature: GZ8MTXP02ISS87.51.6.A06.1.454.CMB.2.raw
  modified_base (264)..(264): a, c, t, g, unknown or other
  misc_feature (264)..(264): n is a, c, g, or t
tcagcgatcgtatacacgaccggtgctcgatttagatctactgacaggggtctgggagacgagcccagcactggaagtcgccggtgtttccattcggtgaccatcactgaacacagaggactcaccatggagtttgggctgagctgggttttcctcgttgctcttttaagaggtgtccagtgtcaggtgcagctggtgcagtcgtgggggagcgtggtccagccgtggggacgtccctgacgtactcctcctgtgaacgtcctntggattcagtcttcagtacgtagtggtttcgcgtcgtcgggtccgccagggtcctaccgaggcgaagggactggcgaggtggggtcgctagtctagttactactaatagtaggaaaaggtaacgaactaattaaactaccgtaacgaccaacggtaccgttaccgggtaggaaaccggggtccctaagtttacccaaccgtacttaccctaccgaacggacaaaccaaacctaacccaaacgtaaacccaacctttaacctttaactacgtacgaactaaactaccgaaaccacctagaacgtacgttagacggaccgagtcgttgtacttattagtgtcgaggagtaaggatacgtacgatacacgacgcg

SEQ ID NO: 323331 - DNA, 549 bp, Homo sapiens
  misc_feature: GZ8MTXP02JDZFE.51.6.A06.1.454.CMB.2.raw
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
  modified_base (355)..(355): a, c, t, g, unknown or other
  misc_feature (355)..(355): n is a, c, g, or t
  modified_base (516)..(516): a, c, t, g, unknown or other
  misc_feature (516)..(516): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggaggtccctgacgactctcctgtgagcctcnggattcagcttcagtacgtatggttncgcgtgggtccgcaggctccgaggcaagggctgcaggtgggtgcatctatatcatagtaggaaaggaancgaaaataaatacgtacgcaagtacctccggtagaaacgggtccgtaattacccgactaacttccgaccaagacgaactaacacccaaagaccacttactttagcacacgaaactaccgaacctacctagactacgtagacgacgacgtctagtactagtnttacgcgagaaggagtagactcgactacagacg

SEQ ID NO: 323332 - DNA, 583 bp, Homo sapiens
  misc_feature: GZ8MTXP02JCRD7.51.6.A06.1.454.CMB.2.raw
  modified_base (299)..(299): a, c, t, g, unknown or other
  misc_feature (299)..(299): n is a, c, g, or t
  modified_base (359)..(359): a, c, t, g, unknown or other
  misc_feature (359)..(359): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggagtccctgagctctcctgtgacgcctcgtggattcagtcttcagtacgtatggtttgcgcgtgggtccncaggcctcgaggcgaaggggctggcgaggtgggtgcatctatatcatagtaggaaagganactaaataaactacgtacgcaacgtaccgtcggtaaggaacgggacctacttaccaacctacgtcctaccgaagaacgaactaaccgacccaaaagaacctaacttaacctttatacgtacgaaccaaactacgaacctaccgtagaacgtacgtaggaacgacgtacggtacttacgtacttagttacgtgtcgaggaaggaggtagactcgactcgactacg

SEQ ID NO: 323333 - DNA, 770 bp, Homo sapiens
  misc_feature: GZ8MTXP02HSOYV.51.6.A06.1.454.CMB.2.raw
  modified_base (191)..(191): a, c, t, g, unknown or other
  misc_feature (191)..(191): n is a, c, g, or t
  modified_base (317)..(317): a, c, t, g, unknown or other
  misc_feature (317)..(317): n is a, c, g, or t
  modified_base (605)..(605): a, c, t, g, unknown or other
  misc_feature (605)..(605): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtncagctggtgcagtcgtgggggagcgtggtccaggcctggggacgtccctaggacgacttctccgtggtagaacgtcccttcgtgggattcagtcttacgagtacgtgtggttgcgtcgtgggtccnccgtagcctcgaggcgaagggctggcgtaggtggggtcgacctagttctaatactactaataggtaggaaaagggaactaccaaaaattaaaactaccgtaacgactaacgtaccttcccgggaaagaaacggggacccttaattacccaaacctacgttacccgaacccgaaagggtaaccaaaaccctaaacgtaaaccccaaaaggtaaacccctaacgtttaaccctttttaaagccgttaaccggaaacctaaaacgttacccgggaaaacccttaaacccgnggtaaaccgtaaccgtttagggaaaaccggtaacccgaacggggttcctttaaacgggttacttaaacttttacggttacgggtaccgggtaacgggtaaacgggggtaaacggggaaacgtttaaccgggtaaccaaaccggttaaccaaaacccggtacccgg

SEQ ID NO: 323334 - DNA, 627 bp, Homo sapiens
  misc_feature: GZ8MTXP02FUTM8.51.6.A06.1.454.CMB.2.raw
  modified_base (240)..(240): a, c, t, g, unknown or other
  misc_feature (240)..(240): n is a, c, g, or t
  modified_base (303)..(303): a, c, t, g, unknown or other
  misc_feature (303)..(303): n is a, c, g, or t
  modified_base (465)..(465): a, c, t, g, unknown or other
  misc_feature (465)..(465): n is a, c, g, or t
  modified_base (521)..(521): a, c, t, g, unknown or other
  misc_feature (521)..(521): n is a, c, g, or t
  modified_base (528)..(528): a, c, t, g, unknown or other
  misc_feature (528)..(528): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcaggtcgtgggggagcgtggtccagccgtgggacgtcccngacgctctcgtgtgagctgtggattcagtcttcaggtacgtagtggttgcgtcgtcgggtccncgaggcctacgaggacgaagggctagcgtagggtgggtcgactagtctaagtatacaagtagtaggaaagaacgtctaaaagtaaactacgtacgacaacggtaccgttacgggaggaacgggcctaataccactactccgtaccaaggaacaaccaaaacncccgaaaacgtaaaccaacttaacttactacttaacgaactaaaacgtcgaaaccnccgtaanaccggtaagtcggaacgtaacgtacggtactacgttacttaacgtttacgttgacgtacgggaaggtacggtaatacggtaccgtaacgacgacgaacg

SEQ ID NO: 323335 - DNA, 557 bp, Homo sapiens
  misc_feature: GZ8MTXP02JHPXV.51.6.A06.1.454.CMB.2.raw
  modified_base (189)..(189): a, c, t, g, unknown or other
  misc_feature (189)..(189): n is a, c, g, or t
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (428)..(428): a, c, t, g, unknown or other
  misc_feature (428)..(428): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcaggtcgtgggggagcgtggtccagccgtgggagtccctgagactctcctgtgagcctgtggattcagcttcagtacgtatggttgcgtcgtgggtcccncgaggcctccgaggcaagggctgcgaggtgggngcatcatntcatatgaaagaacgctaaaataagtactacgacagtacctccgagaacgggccctatcacctatcaccaagacacaactacccaaaanactactacttancgtanaactaagtacgaacctacgtagacgtacgtacggaacgtacgacggtctacgttacttagttacgtacggtacggacggaaggacggtacgtacgtacgtactacgacgacg

SEQ ID NO: 323336 - DNA, 687 bp, Homo sapiens
  misc_feature: GZ8MTXP02HDX3P.51.6.A06.1.454.CMB.2.raw
  modified_base (172)..(172): a, c, t, g, unknown or other
  misc_feature (172)..(172): n is a, c, g, or t
  modified_base (257)..(257): a, c, t, g, unknown or other
  misc_feature (257)..(257): n is a, c, g, or t
  modified_base (301)..(301): a, c, t, g, unknown or other
  misc_feature (301)..(301): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagnggtgtccagtgtcaggtgcagctggtgcaggtcgtgggggagcgtggtccagcctgggagtccctgagctctcgtgtgacgcctntggatcagtcttcgagttacgtatggtttgcgtcgtgggtcccnccgaggcctccgaggcgaagggctgcgaggtggtgctatcgtatatcagtagtaggaaaggaatactaaaagttaaaactaccgtaacgactaacgtaccgttaccgggtaaggaaaccggggtcccgtaattaccccgaaccgtaaccgtttaccctaacccggaagaaccgaaaaccctaaaccgtaacccccaaaaaacggtaaaccctaacttaacctttttaacacccgttaaacgaaacctaaacgtaccgaaaccctaccgtaaggaacgtacgtacggaacggtaccgtacggttacttacgttacgtttaacgttacgttacggacggtaacgggtaagggtaacggtaacgtacgtacgtaacgtaacgaacgacg

SEQ ID NO: 323337 - DNA, 608 bp, Homo sapiens
  misc_feature: GZ8MTXP02F1YEH.51.6.A06.1.454.CMB.2.raw
  modified_base (303)..(303): a, c, t, g, unknown or other
  misc_feature (303)..(303): n is a, c, g, or t
  modified_base (405)..(405): a, c, t, g, unknown or other
  misc_feature (405)..(405): n is a, c, g, or t
  modified_base (490)..(490): a, c, t, g, unknown or other
  misc_feature (490)..(490): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtgggacgtccctgagactctctgtgaacgctctggattcagcttcaggttacgtattggttgcgtcgtgggtcccncgtagggcctccgaggcgaaaggggctggcgtaggggtcgggtgactagttctaatatcaagtagtaggaaaggaacgactaaataaaacgtacgtaccganacgtactaccgggtagaaccggggtctattaccactactctaccaaggaaccacaaactacccgaaataacctaacttactttanacctagaaacctaaatccggtaaacctccgtaagacgtacgtaggacgacgtacgtcgtactacgttattacgttggacggtacgaaagggcggtaactacgtacgtacacgacgacg

SEQ ID NO: 323338 - DNA, 520 bp, Homo sapiens
  misc_feature: GZ8MTXP02JCD8V.51.6.A06.1.454.CMB.2.raw
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
  modified_base (345)..(345): a, c, t, g, unknown or other
  misc_feature (345)..(345): n is a, c, g, or t
  modified_base (372)..(372): a, c, t, g, unknown or other
  misc_feature (372)..(372): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (487)..(487): a, c, t, g, unknown or other
  misc_feature (487)..(487): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagcctgggacggtccctgagactctctgtgaagcctntggattcagtcttcagtacgtatggttgcgtcgtggggtcccncgaggcctcgaggcaagggctggcaggtgggtgcatctatactnatatggaaagagcaaataaatacacgnagctcgtagacggcatcacatcaccagacacaacnccaaagacactactttanactanaacaaagtacaacacctaggacacgtagacgtacacggtctgtactattacgttcgngacgaaggaggagacgtacgactaccgacgacg

SEQ ID NO: 323339 - DNA, 622 bp, Homo sapiens
  misc_feature: GZ8MTXP02HWPQN.51.6.A06.1.454.CMB.2.raw
  modified_base (308)..(308): a, c, t, g, unknown or other
  misc_feature (308)..(308): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggacgtccctgagactctcctgtgaacgcctctggattcagtcttcgagttacgtagtggtttcgcgtcgttggggtcccnccgaggcctccgaaggccgaaaggggcctggcgtagggtgggtgactatcgtatatcaagttataggaaaaggaagactaaaagttaaaactacctaacggaccaaggtacctccggtaggaaacgggtcccgaacttaccgaccctatacgtacccaagacgaaccactacccaaagaacctactaactttactactacgactaaaacgtcgaaactacccgtagaacgtacttaggaacgtacgacggtctacgtacttagtttaacgtgtacgacggaaggaggggtacgacgtacggactacgaacacgg

SEQ ID NO: 323340 - DNA, 644 bp, Homo sapiens
  misc_feature: GZ8MTXP02F6Q8V.51.6.A06.1.454.CMB.2.raw
  modified_base (172)..(172): a, c, t, g, unknown or other
  misc_feature (172)..(172): n is a, c, g, or t
  modified_base (190)..(190): a, c, t, g, unknown or other
  misc_feature (190)..(190): n is a, c, g, or t
  modified_base (260)..(260): a, c, t, g, unknown or other
  misc_feature (260)..(260): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagnggtgtccagtgtcaggtncagctggtgcaggtcgtgggggagcgtggtccagccgtgggacgtccctgacgactctcctgtgagcctntggattcagcttcagtacgtatggttgccgtcgtcgggtcccgcgaggcctaccgaggcaaagggctggcgaggtgggtgctagtctaatatcaagtagtaggaaaggaagactaaaagttaaaactaccgtacgactaagtacccgttccggtaaggaacgggccctaacttaccaaccgtactccgtaccgaaggaactaacaaaacctaccccgaaaaagtaaccctaaacttaacctttacgtacctacgtaaaccaaaacttacgaaaccctacccgtagaaccgtaacgttaggaacgtaaccgacggttcttacgttaacttacgttagttcggtcgaaggaagggaggtacgtacgtacgaactaccgacgaaccg

SEQ ID NO: 323341 - DNA, 704 bp, Homo sapiens
  misc_feature: GZ8MTXP02IPZ0P.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagcccaccctcggtgtccgtcgtccccaggacaggacgccaggatcacctgctctggagatgctattcgaccaaccctacttatttcttagttacggtaccagacaagaagcccgaacggccacggccccttgttcgtttgttcgataataaataaagaccactagagacgtccttacgagggtctcccgtagacgacgttacttcgtcgtcggtcctccctaccctcggaacggaactaaagttcggtacctaacgtagttacgaccctagttacgaagggttcggaacgtaccgacggaccggaaagaaacggtaccggaaggtacgttaacggtaacgttttaacttttcgtaacggtttaacctaaacgtttaccgtttacgaaaacgtaacgttaaacttaccgttaaagggtttacgggtttaactttaaacggttttccggtttaaccgggtttaccggttaaaccgggttaacgggggtaaaacccggtttaaacccgggg

SEQ ID NO: 323342 - DNA, 616 bp, Homo sapiens
  misc_feature: GZ8MTXP02F9UAE.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgctattcgacccaaaccctacttattcttattggtaccagacagaacgccaggccaggccctgtgttgttgatatataaagacactgagagcttcgaggtactcccgtgacgcgtacttctctaccggctacccactcgagggaacaagtcggtcaactagttaccgacctaagtcgaaaggtcggtacgtacccgaggaaccgaaaggtaaacggaacggtacggtacttacgtaactttacgtttacgtgttacctaaagttccttacagtaactagtacgtagtacggttaactttagtgtacgttacggaacgtcgggaaccaaggtccgtaccggtactacggtacaaccggtcccaaacggcccaacccacgtctacctactctttaccccg

SEQ ID NO: 323343 - DNA, 630 bp, Homo sapiens
  misc_feature: GZ8MTXP02GBMFF.51.6.A06.1.454.CMB.2.raw
  modified_base (396)..(396): a, c, t, g, unknown or other
  misc_feature (396)..(396): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtcgtccccaggacagacggccaggatcacctgctcgtggagatgctattcgacccaaaccctacttatttccttaagttcgggtaccagacagaacgccaggccacggcccctggtgttgtgatataataaagacactgagacggtccttcgaggactcccgtgagcgtattctcgtcggcctccacgtacgaggacaagtcgtacactataccgactanacgtaggtacgtacgtacggagacgaaaggaacggacggacgtacgtacgtatttacttcgtatactattctagactactactagtaggttacgttacttagttacgttacggtacggtaacggtaccggtaacggtaacggtacccgtaccggttacgttaccggacctaccgaaacccgaacccgtaccccaaaccgtacggtacctaccgtaccttaccggtttccccccg

SEQ ID NO: 323344 - DNA, 638 bp, Homo sapiens
  misc_feature: GZ8MTXP02HXHPU.51.6.A06.1.454.CMB.2.raw
tcagcgatcgtatacacgaccggtgctcgatttagatctactgacaggggtctgggagacgagcccagcattggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagactctcctgtgaacgcctcgtggattcagtcttcagttacgtagtggtttcgcgcgtcgggtcccgccgaggcctccgaggcgaaaggggctgggcgtagggtggggtgctagtctatatcataatagggaaaaggaacgactaaaattaaaactacgtaaccgactaacggtacctcccgggtaggaaacgggacccgtaattacccaaccgtacttacctacccgaagaacgaaacctaaacacccaaaacgaaacctaacctaacttttaacacctagaaacctaaaacgtacgaaaccctaacccgtagtaacgtacgttagaacggacgtacggtacgtacgttacttaattagttgtacgacgtaaggaggtagacgtacgactacacgaacg

SEQ ID NO: 323345 - DNA, 586 bp, Homo sapiens
  misc_feature: GZ8MTXP02JJHCU.51.6.A06.1.454.CMB.2.raw
  modified_base (155)..(155): a, c, t, g, unknown or other
  misc_feature (155)..(155): n is a, c, g, or t
  modified_base (189)..(189): a, c, t, g, unknown or other
  misc_feature (189)..(189): n is a, c, g, or t
  modified_base (255)..(255): a, c, t, g, unknown or other
  misc_feature (255)..(255): n is a, c, g, or t
  modified_base (300)..(300): a, c, t, g, unknown or other
  misc_feature (300)..(300): n is a, c, g, or t
  modified_base (360)..(361): a, c, t, g, unknown or other
  misc_feature (360)..(361): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttccncgttgctcttttaagaggtgtccagtgtcaggtncagctggtgcagtcgtgggggagcgtggtccagccgtgggagtccctgagctctcctgtgagcctntggattcagtcttcagttacgtatggtttgccgtcgtcgggtccncgaggcctacgaggcgaagggctgcgaggtggtgcagtctatatcatagtagaaaggaannaaataaatacgacgcaagtacctcggtagaacggtaccgacgttacactactctaccaagacgtaacaactaccaaacgaacctaactaacttttacactacgaactaaataccgaaacctacccgtagacgtaacgttaggaacggtacgtacggtcgtacgttacttaacgtttagtacggtggaaggaaggaggggtaacgtacgtacgacacacgtaaccg

SEQ ID NO: 323346 - DNA, 697 bp, Homo sapiens
  misc_feature: GZ8MTXP02HEZEW.51.6.A06.1.454.CMB.2.raw
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccaggccgtgggacgtccctggacgcctctctgtgacgcctctggattcgagtcttagacggttacgtattggttgcgtcgtcgggtccgcgacggctccgaggcgagggactgcgaggtgggngccatntactatacatagtaggaaacggaagacctaaaataaaactaccgtaacgacgaacgtacccgtaccgggtaagggaaccgggaccctaagttacccaaccctacgttacccaacccgaaagaaacccgtaaaccaaaccgtaaccccaaaacgaaacctaactaaccttttaacgcttaacggaaaaccctaaaacgtaccggtaaaacccctacccgtaggtaaaccggttacttaacggggaaccggtaccaacggggttacttacggttactttaacgttacggtttcggaaccggtacgggaaggaagggtaacgtaacgttcgaaccgttccaaaggacccgg

SEQ ID NO: 323347 - DNA, 682 bp, Homo sapiens
  misc_feature: GZ8MTXP02HSYXX.51.6.A06.1.454.CMB.2.raw
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
tcagcgatcgtatacacgaccggtgctcgatttagatctactgacaggggtgggtccaggaggcagaactctgggtgtctcaccatggcctggatccctctacttctccccctcctcactctctgcacaggctctgaggcctctatgtgctgacacagccaccctcggtgtccgtgtccccaggacagacggccaggatcacctgctctggagatgctattcgaccaacccatattcgttattggaccagcagancagcaggcccngtgtgtgatatataaagacatgagaggccttcgagggtacncccgtgagccgttnttctcgtccgcctaccgacgtacgaacggactagtcggtacaactagtacgaacctatacgtaggtagtacgtaccgacgacgaacggaaacggaacggtaacggtacgtacgtaacgttacgtttacgttacgttacgttaaacttaccgttaacgtaacgtaacgtaacgttaacgttaacggttacggttaacgtttaacgtttacggtttacggttaacggttaacggttaaccgggtaaccggtaaaccggttaaccgtaacccggttaccgtaacgtaccgtaacccgtaacccgtaaacccggtaacccgtaaccccgtaccgttaccgtaccgtacccgttacccgttacccg

SEQ ID NO: 323348 - DNA, 637 bp, Homo sapiens
  misc_feature: GZ8MTXP02GKU0W.51.6.A06.1.454.CMB.2.raw
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (302)..(302): a, c, t, g, unknown or other
  misc_feature (302)..(302): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtggggagcgtggtccagccgtgggagtccctgagctctcctgngaagcctntggattcgagtcttcagttacgtattggttgccgtcgtggggtcccncgtaggctccgaggcgaagggctggctagggtgggtagcattcgtatatcaatagacggaaaggtaactaccaaaattaaaacgtacctacgactaacgaccgtccggtagggaaacgggtccctaatttacccgaacctaacttacccgaccgtaaaggaactaaaccaaacctacccgaaaagtaaccaacttaacctttaacacgtaacgaactaaaacgacgaaaccctcgtaagacgtacgtaggacgtaaccgcggtattacgtaacttattacggtcggtaggacggtaaggacggtaagaccgtacggaactaccggaacgtaaccg

SEQ ID NO: 323349 - DNA, 585 bp, Homo sapiens
  misc_feature: GZ8MTXP02I3869.51.6.A06.1.454.CMB.2.raw
  modified_base (171)..(171): a, c, t, g, unknown or other
  misc_feature (171)..(171): n is a, c, g, or t
  modified_base (189)..(189): a, c, t, g, unknown or other
  misc_feature (189)..(189): n is a, c, g, or t
  modified_base (198)..(198): a, c, t, g, unknown or other
  misc_feature (198)..(198): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
  modified_base (487)..(487): a, c, t, g, unknown or other
  misc_feature (487)..(487): n is a, c, g, or t
  modified_base (524)..(524): a, c, t, g, unknown or other
  misc_feature (524)..(524): n is a, c, g, or t
  modified_base (547)..(547): a, c, t, g, unknown or other
  misc_feature (547)..(547): n is a, c, g, or t
  modified_base (569)..(569): a, c, t, g, unknown or other
  misc_feature (569)..(569): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagnggtgtccagtgtcaggtncagctggtncaggtcgtgggggagcgtggtccagccgtgggacgtccctgacnctctctgtgatcctntggattcagtcttcagtacgtatggtttgcgtcgtgggtccnccgaggcctcgaggcgaaggggtactggacgaggttggggtgctagttctaagtntacaatagtagaaacgggaanacaaataaacgtaacgtacgcaagtacgtccggtaaggaacgggtcctagtccacctatctaccaaggacaacactaccaaagacctactacgtttanacgtanaactaaancgaacccactagacgtatacggaacggtacgaccgtntacgtacttaagttcgttacggnggacgaagggtagggaatacgngtaactcgaacgtacg

SEQ ID NO: 323350 - DNA, 580 bp, Homo sapiens
  misc_feature: GZ8MTXP02FI20H.51.6.A06.1.454.CMB.2.raw
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (442)..(442): a, c, t, g, unknown or other
  misc_feature (442)..(442): n is a, c, g, or t
  modified_base (466)..(466): a, c, t, g, unknown or other
  misc_feature (466)..(466): n is a, c, g, or t
  modified_base (547)..(547): a, c, t, g, unknown or other
  misc_feature (547)..(547): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtgggtcccaggccgtggggaggtccctgagactctcctgtgaagcctctggattcagcttcagtacgtatggtttgcgtcgtgggtccnccgaggcctccgaggcgaagggactgcgaggtgggtgcatctatntcatatagaaaggagcaaataaactactacgacaacgaccgtaccgtaggaacgggccgtattacacctatccaccgaagacgactaaaccnccgaaagaaaccactaactttacncttacgaactaaaatcgaaacctaccgtacgagaccgttggaacggaccgaacggtccttagtacttacgttacgttaggnggacgaaggagggaagacgtacgacacgacacg

SEQ ID NO: 323351 - DNA, 538 bp, Homo sapiens
  misc_feature: GZ8MTXP02HOE73.51.6.A06.1.454.CMB.2.raw
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
  modified_base (432)..(432): a, c, t, g, unknown or other
  misc_feature (432)..(432): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtcctgagctctcctgtgagcctctggattcagcttcagttacgtatggtttgcgtcgttgggtcccgccgaggcctccgaggcaaaggggctgcgaggtgggtgctatctatatcatagtgaaaggancaaataaatactacgnagactcgagacggcgatcacatctacagacgacaactccaaagaactactaactttanctagacaaactacgaaccacctagaacgtacgtagaacggacaacggtctcgtacttagtttacgtggtagacggtaaggagggaatacgacgactccgaacacgg

SEQ ID NO: 323352 - DNA, 620 bp, Homo sapiens
  misc_feature: GZ8MTXP02JAY6I.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgctattcgacccaaaccctacttattcttaagttcggtaccagacagaaacgccaggccaggcccctgtgttgtgatatataaagcacgtggagaacggccttagacggggtactcccgtagacgcgtattctcgtcgcctccactcgaggtaacagtcggtacacattcgaacctagtccgtaaggtaggacgtccgaggacaaggaaagaccggtaggccttaggtactagtttcgtacgttacaaattcttgaacgttacgaattcgaaggttagttacttaagtcgtttacgtaacgggtaacgtacgggaccgtaggtaccgtaaccgttacgtagggtaccaccggaccaaaccggacccaaccccgtacgtacgtacctaccgttccttaccccg

SEQ ID NO: 323353 - DNA, 554 bp, Homo sapiens
  misc_feature: GZ8MTXP02HJJFD.51.6.A06.1.454.CMB.2.raw
  modified_base (170)..(170): a, c, t, g, unknown or other
  misc_feature (170)..(170): n is a, c, g, or t
  modified_base (263)..(263): a, c, t, g, unknown or other
  misc_feature (263)..(263): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (473)..(473): a, c, t, g, unknown or other
  misc_feature (473)..(473): n is a, c, g, or t
tcagcgatcgtatacacgaccggtgctcgatttagatctactgacagggcacgaccggtgctcgatttagatctactgacagggggctgtgggtccagggaggcagaactctgggtgtctcaccatggcctggatccctctacttcctccccctcctcactctctgcacnggctctgaggccctcctatgtgctgacacagcccacccgtcggtgtccgtcgtccccaggacaggaccggccaggatcacctgcctcgtgganatgcatcgacccaacccacttattcttattcggtaccagtcagagccaggccacggcccctgtgttgtnatatataaanaccactgagcggccttcgagggtctccgtgagcgtattctcgtcgctaccacctcgaggactaagtgtacactattacgaccagtcaggtgacgtccgagacgagaacgacgaggctagtacttatttcgngttactaacgtcttacgacgtacatacgtagtagttaacttagtacgttacgttacggtacgtacggggtaaccctaacgg

SEQ ID NO: 323354 - DNA, 648 bp, Homo sapiens
  misc_feature: GZ8MTXP02HV4OI.51.6.A06.1.454.CMB.2.raw
  modified_base (296)..(296): a, c, t, g, unknown or other
  misc_feature (296)..(296): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctctatgtgctgacacagccaccctcggtgtcccgtgtccccaggacagacggccaggatcacctgctctggagatgcattcgacccaaccctacttatttcttagttcggtaccagcagaacgccaggccacggcccctgtgttgtgatataanaaagacactgagaggtccttgaggactccgtgacgcgtattctctcggcctacccacgtacgaaggactaagtcggtacctaactattaccgaacctatactagggtacggtacgtaccgaaggacaaaggaaaacgacggaaggtcgtacgttaaactttaagttttccgtagttaccttaaagttccctttagaactaactacgttagtacggttacgttaacgtttacgttacgttaccgtttacgggtaacgttacggggaaccgtaaacggtacctaccggttacgtacgtaccgaaccgacccgaaaccggtacccaaccctacgtacgtacctacttcgtacccc

SEQ ID NO: 323355 - DNA, 574 bp, Homo sapiens
  misc_feature: GZ8MTXP02IYU7S.51.6.A06.1.454.CMB.2.raw
  modified_base (300)..(300): a, c, t, g, unknown or other
  misc_feature (300)..(300): n is a, c, g, or t
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
  modified_base (435)..(435): a, c, t, g, unknown or other
  misc_feature (435)..(435): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtgcagtcgtgggggaggcgtggtccagccgtgggaggtccctgagactctcctgtgagcctctggattcagtcttcagtacgtatggttgcgtcgtgggtccncgaggctccgaggcaagggctggcgaggtgggngcatctatatcatatagaaagganctaaataaanactacgnacgactccgagacggccatccacntcaccagacgacactaccaaagaaccactacttttancctagaactaaagtcgaaacctaccgtagaacgtacgttaggaacgaacgtccgggtactacggttacttaaacgtttacttacggtaggtaaccggaagggtaggggtaaagacgttaccggaattaccgaacgaacg

SEQ ID NO: 323356 - DNA, 620 bp, Homo sapiens
  misc_feature: GZ8MTXP02G9MO0.51.6.A06.1.454.CMB.2.raw
  modified_base (261)..(261): a, c, t, g, unknown or other
  misc_feature (261)..(261): n is a, c, g, or t
  modified_base (371)..(371): a, c, t, g, unknown or other
  misc_feature (371)..(371): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
  modified_base (553)..(553): a, c, t, g, unknown or other
  misc_feature (553)..(553): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcagtcgtgggggaggcgtggtccagccgtgggacggtccctgagactctcctgtgagccctntggattcagtcttcagttacgtagttggttcgcgtcgtgggtccgccgagggcctaccgaggcgaaaggggtcctgggacgagggttcggggtgacaattctaatactanattaagaggaaaacggagacaaaataaaactcgtaacgcaaaggtacgtcccggtaagaacggggaccctattaccaacctatacctaccgaagaacgaaccaaacgacccaaaagtaaccactactttaancgtaanaactaaactacaacctacgtagacgtacgtaggacgacgacgtnttacgtacttaagttacgtcgaggtacggaaggtagggtaacgtacgtacgaactacgaacgtaacg

SEQ ID NO: 323357 - DNA, 689 bp, Homo sapiens
  misc_feature: GZ8MTXP02H7UTD.51.6.A06.1.454.CMB.2.raw
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaacccatattcttattggtaccagcagaagccaggccaggcccctgtgttgttgatatataaagacactgagaggcctttcgagggatcccgtgaacgcgtaatttcccctcgtcggtcctacccaccttcgaaaggggacctaaaacgttgggttaccaacgtaatttacggaaacccctattaccgaaggtcgggaagtacccgaagggaccaaagggaaacggaccgaagggcgtacgaactttaacttttcgttaggttacttaaattccctttcgaacgtaacctaagtacctaaggtttagggttaacctttagttacggttacgtttaccggggaaacgtttcgggggaaacccttaaagggttcctaacccggttccgtttaaggggccctaaacgggcccccctaaaaggggaccccctaaaaacccccgcgttaacggttccctaacccg

SEQ ID NO: 323358 - DNA, 601 bp, Homo sapiens
  misc_feature: GZ8MTXP02GTR7U.51.6.A06.1.454.CMB.2.raw
  modified_base (589)..(589): a, c, t, g, unknown or other
  misc_feature (589)..(589): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagcccaccctcggtgtccgtcgtccccaggacagacggccaggatcacctgctcgtggagatgctattcgacccaaaccctattacttcttaagttcggtaaccagcaagacgccaggccacggtcccctgtgttgtagatataataaagacactggagacgtcctacgaggtctccgtgacgcgtattccctcgtcgcctaccaccgtacgaacgggacctaagttcggtacctaacgtacgttacgaacccagtaccgaggtacggacgtaccgaggacgaaagaacggacgaggtctagtactttagtttcctagtacctaatccttagactactactacgagtttacgtacttagtcgttacgtacggtaacgtggaacctacggtcctaccgtcgtacggcaacgacccgacgtacccaaccncgtcgacctacc

SEQ ID NO: 323359 - DNA, 612 bp, Homo sapiens
  misc_feature: GZ8MTXP02GPQRC.51.6.A06.1.454.CMB.2.raw
  modified_base (297)..(297): a, c, t, g, unknown or other
  misc_feature (297)..(297): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgctattcgacccaaacccacttattctttattggtaccagcagaacgccgaggccacggccctgtgttgttgataatanaaagacactgagacgtccttagagggactccgtgacgcgtacttctcgtcgcctccactcgagggacaagtcggtacaactagttacgaacccagttaccgaggtacgggtacgtacccgaagggaccgaaaggaaaacggacggaacggtcgttaacgtactttaatttcgttacgttactaaacgttcttacgagtaactatacgtaggttagttacttattcgttacgttacggaacgtacggaacgtagtcccgtacgtcgtacgtaccgcgacccgaacgaccccaaccgtctcgtactcctacttcccg

SEQ ID NO: 323360 - DNA, 489 bp, Homo sapiens
  misc_feature: GZ8MTXP02HVMA2.51.6.A06.1.454.CMB.2.raw
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (389)..(389): a, c, t, g, unknown or other
  misc_feature (389)..(389): n is a, c, g, or t
  modified_base (431)..(431): a, c, t, g, unknown or other
  misc_feature (431)..(431): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtggtttcgcgttaggctctttaagaggtgtcagtgtcaggtgcagctggtgcagtctgggggagcgtggtccagcctgggaggtcctgagctctctgtgaagcctntgggattcagctcagtaagtntgttgcgctggtcgcagctcagcaggactgcagtggtggcatctactatacanatgaagaagganaaataaatactacgacacgacgtacgagacgacgactacacatactacaganacacacaacaacactacttatactacacaacacacacacganactagacgacgacgactactatacttactacgtagagaagagacgacagacacacacg

SEQ ID NO: 323361 - DNA, 689 bp, Homo sapiens
  misc_feature: GZ8MTXP02G2IYQ.51.6.A06.1.454.CMB.2.raw
  modified_base (190)..(190): a, c, t, g, unknown or other
  misc_feature (190)..(190): n is a, c, g, or t
  modified_base (255)..(255): a, c, t, g, unknown or other
  misc_feature (255)..(255): n is a, c, g, or t
  modified_base (281)..(281): a, c, t, g, unknown or other
  misc_feature (281)..(281): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtncagctggtgcagtcgtgggggagcgtggtccagcctgggagtccctgagctctcctgtgagcctntggattcagtctcagtactatggttncgtcgtgggtcccgccgaggtcctcccgagggaccgaaaggggaccttggcgtagggttggggtgccaattctaattataccaagtaagtaggaaaaggggaaactacaaaattaaaactaacctaacgggacaagggaaccttcccggtaagggaacggacccgtaacttaccgaacctaactacctacccgaagaacgaaaccaaactacccaaaacgaaacctaactaaccgtttttaacacgttacgaacgaaaaacttacggaaaaccctaaccccgtagtaaaccgtaaccgttaggaaacggaaaccgtaaacccgggttacttacgttaccttaaagtttacgttacggtacggaaggtaagggaacgggtaacgtacgtacgtaacgacgtaacgacgg

SEQ ID NO: 323362 - DNA, 544 bp, Homo sapiens
  misc_feature: GZ8MTXP02JG93R.51.6.A06.1.454.CMB.2.raw
  modified_base (356)..(356): a, c, t, g, unknown or other
  misc_feature (356)..(356): n is a, c, g, or t
  modified_base (397)..(397): a, c, t, g, unknown or other
  misc_feature (397)..(397): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagccgtgggaggtccctgagactctcctgtgagcctctggattcagcttcagtacgtatggtttgcgctgggtcccgccaggcctccgaggcaaggggctggcaggtgggtgcatctatatcatatagaaaggaancaaataaatactacgcagactcgtagaggccgatcacatcncagagacactaccaaagaacactaactttacactagaacaaatacgaaaccacccgtagaacgtacgttagaacggaacgacggtactacgtacttagttacgttaggtagtacggaaggagggaagacgtacgactacgacgacgg

SEQ ID NO: 323363 - DNA, 625 bp, Homo sapiens
  misc_feature: GZ8MTXP02IJQ86.51.6.A06.1.454.CMB.2.raw
  modified_base (330)..(330): a, c, t, g, unknown or other
  misc_feature (330)..(330): n is a, c, g, or t
  modified_base (407)..(407): a, c, t, g, unknown or other
  misc_feature (407)..(407): n is a, c, g, or t
  modified_base (475)..(475): a, c, t, g, unknown or other
  misc_feature (475)..(475): n is a, c, g, or t
  modified_base (492)..(492): a, c, t, g, unknown or other
  misc_feature (492)..(492): n is a, c, g, or t
  modified_base (559)..(559): a, c, t, g, unknown or other
  misc_feature (559)..(559): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctgggtgcgaggtcgtgggggaggcggtggtccaggccgtggggacggtccctggacgtacctcgtccgtggtacgaacgcctacgtggtacttcagtcttacgaggtacgtagttggttcgcgtcgtgggtcccncgaggcctaccgaggacgaaagggctgggactagggtcggggtgacattccgtaatactacattagaggaaacgganactaaataaatacctacgcaagacctcggagacggcgatacactatcacagacgacaactaccgaaanaacctactaactttacncctagaactaaacgtacgtaaacccaccgtagtaacgtacgttagaacggtacgtacggtaccgttntaacgttaacgtttagtacggtagacggtaaggtaacgggataacggtacacgtaaccaacgtacg

SEQ ID NO: 323364 - DNA, 684 bp, Homo sapiens
  misc_feature: GZ8MTXP02GOC02.51.6.A06.1.454.CMB.2.raw
  modified_base (199)..(199): a, c, t, g, unknown or other
  misc_feature (199)..(199): n is a, c, g, or t
  modified_base (302)..(302): a, c, t, g, unknown or other
  misc_feature (302)..(302): n is a, c, g, or t
  modified_base (354)..(354): a, c, t, g, unknown or other
  misc_feature (354)..(354): n is a, c, g, or t
  modified_base (511)..(511): a, c, t, g, unknown or other
  misc_feature (511)..(511): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtncagtcgtgggggagcgtgtccagccgtgggacgtccctgacgtactctctgtgacgcctgtggattcagtcttcagtacgtatggtttgcgtcgtgggtcccncgaggcctccgaggcgaaggggctggcgaggttggggtgcagttctaactancgtaagtacgtaggaaaaggaagcctaaaataaacgtaccgacgacaaggtaccgtaccggtaggaaacgggtcccgtaacttaccgaacctacgtacctacccgaagaacgaaaccaaaccgtacccgaaaacgtaaccctaacgttaccttttanacccgttaagaaaccctaaaacgttaccgaaaacccgtacccgttaaggaaacggtaaccgttagggaaacggttaacccacggggttaccttagtttaccgttaagttttaacggtcggttaggaaccggtaaggaacgggtaagtacttacgacttaccgaacgtaaccgg

SEQ ID NO: 323365 - DNA, 605 bp, Homo sapiens
  misc_feature: GZ8MTXP02I4R5S.51.6.A06.1.454.CMB.2.raw
  modified_base (189)..(189): a, c, t, g, unknown or other
  misc_feature (189)..(189): n is a, c, g, or t
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
  modified_base (298)..(298): a, c, t, g, unknown or other
  misc_feature (298)..(298): n is a, c, g, or t
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcaggtcgtgggggaggcgtggtccagcctggggacgtccctgagctctccngtgagcctgnggattcagcttcagtacgtatggttgcgtcgtgggtccncgaggcctacgaggacgaaggggctggcgtaggtgggtgacactactatactactatagagaaagananaaatacacagctaagactcggtaagaccggctactaccactagtccacgagtacaacaaccgtaacaaacgaacctaacttacttagctaagaaacaacgtacgaaaccctcggtaagaccgtaacgtacgggaacgaaccgtcggttacttcggttaaacttacgtttaggtacggttaaggaacgggtaacgggaaggggtaactaaccggtacgtaaccaccgaaagtaccccgg

SEQ ID NO: 323366 - DNA, 722 bp, Homo sapiens
  misc_feature: GZ8MTXP02HYLQN.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacaggacggccaggatcactgctctggagatgctattcgacccaaaccctattatttctttaatcggtaacccagacaagaacgccaggccacggcccctgtgttgtagataataataaagactaacgtgaaggtacggtcctttacgaacggggtactacccgtgacgacgtattctcgtcgcctcctaccgtacgacgggacaagtcggtacaactacttcgaacctacgtctaggttcggacgtaccggaaggacgaaggaaacgaacgaggtactaggtaacctttagtttacgtacgttactaaagttcctttacgaacggtacctaacgttacgtaaggttacggtttaactttaacggttcgttaccgtttaaccggggtaaaacggttcggggaaacccgttaaagggttcccgtaaaccgggttacccgttaacggggtaccctaaaccggaacccccgtaaaaccgaacccccgttaaaaccccgtacccgttacgtaaccccgttaacctttccgtttacccccg

SEQ ID NO: 323367 - DNA, 646 bp, Homo sapiens
  misc_feature: GZ8MTXP02GA540.51.6.A06.1.454.CMB.2.raw
tcagcgatcgtatacacgaccggtgctcgatttagatctactgacagggggctgtgggtccaggaggcagaactctgggtgtctcaccatggcctggatccctctacttcctcccccctcctcactctctgcacaggctctgaggcctcctatgtgctgacacagcccaccctcggtgtccgtgtccccaggacagacggccaggatcacctgctctggagatgctattcgacccaaaccctattatttccttagttcggtaaccagacagaacgccaggcccacggcccctgtgttgttgaattaataataaaagacacgtaggaggtacggtccttacggaacgggtacctcccgtggacgtcgtattccccgtcgtcggtcctacccgacctacgaacgggactaaagtcggtaccaactattacgacctatacgaggtcgacgtaccgagacgaaggaacgaacgacggtctacgtatttacgttacgttacgtactaagttcctttacgaagtaacctagtacgtaggttacgttactttagtcgttacgttacggacgttacggacccgtaaggtaccgtaccgtacgtacgtaccgaacgtacccgaacggacccccaaccgtcgtaccgtactacccg

SEQ ID NO: 323368 - DNA, 674 bp, Homo sapiens
  misc_feature: GZ8MTXP02IM9G3.51.6.A06.1.454.CMB.2.raw
  modified_base (263)..(263): a, c, t, g, unknown or other
  misc_feature (263)..(263): n is a, c, g, or t
  modified_base (528)..(528): a, c, t, g, unknown or other
  misc_feature (528)..(528): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggaggcgtggtccaggccgtgggacggtccctgagtactctcctgtgagcctntggattcagtcttcagttacgtattgggtttcgcgtcggtcggggtcccgccgagggcctacccggaggacgaaacggggccttggcgtagggttggggtacgctaagtctaatactactaattagtaggaaaagacgactaaaattaaaatccgaacgactaacgaccgtacccggtagaaaccggggccctattaccaaccgtactactacccgaagaacgtaacaaaccgacctaaaacgaaccttaactaacccttttaanactacgaaactaaactaccgaaacctaccgtagtaacgtacgtaaggaaaccgtacgtaccggttacttacgtttactttaagtttacgttaggtacggtaacgggaagggtaacggtaacgtacgtaacgtactaccgaacgacg

SEQ ID NO: 323369 - DNA, 655 bp, Homo sapiens
  misc_feature: GZ8MTXP02GOJI9.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaacccacttattcttattcggtaccagcagaagccaggccaggccctgtgttgtgatatataaagacactgagaggtccttacgagggactcccgtggacgcgtattctcgtcggcctcccacctcgaagggacctaaagtcggtaccaactattacgaacctagtccgagggtacggacgtacccgaagggacgaaaggaaacgaacggaggtactaggtaacctttatttcgtacgttactaaacttcctttagaacgtactatacgtaaggtttaggttactttagttcgttacgttacgggtaacgttacgggaccgttaaaggtacccgtaacccgttaccgttacggtaccgaaccgaccccgaaaccggacccccaaaacccccgtacgttaccgtaccttaaccttccgtttaccccg

SEQ ID NO: 323370 - DNA, 575 bp, Homo sapiens
  misc_feature: GZ8MTXP02GG72M.51.6.A06.1.454.CMB.2.raw
  modified_base (503)..(503): a, c, t, g, unknown or other
  misc_feature (503)..(503): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaccctacttattcttattcggtaccagcagaagccaggccacggccctgtgttgttgatataataaagacactgagaggtccttacgagggactcccgtgacgtacgtattctcgtcggcctcccaccgtcgaacgggaaccaagtcggtaccaacgtagttacgaaccctagtcgacggttagggacgtccgaggacgaaggaaagtacggacggtactagtaacttatttctagtactaaattcttacaagtacatctagtgttacttagtntcgtagacgtggactaggtcacgtcgtagtcacgaccgaacgacccaacccacgtcacctacgttcctaccg

SEQ ID NO: 323371 - DNA, 632 bp, Homo sapiens
  misc_feature: GZ8MTXP02F441G.51.6.A06.1.454.CMB.2.raw
  modified_base (303)..(303): a, c, t, g, unknown or other
  misc_feature (303)..(303): n is a, c, g, or t
tcagcgatcgtatacacgaccggtgctcgatttagatctactgacaggggtctgggagacgagcccagcactggaagtcgccggtgtttccattcggtgatcatcactgaacacagaggacccaccatggagtttgggctgagctgggttttcctcgttgctcttttaagaggtgtccagtgtcaggtgcagctggtgcaggtcgtgggggaggcgtggtccaggccgtgggacggtccctgagactctcctgtgaagcctctggattcagcttcagtacgtatggtttgcgtcgtgggtccnccaggctccgaggcaaggggctgcaggtgggtgcatctatactcatagtacggaagaagtacaattaaatacgtaacgacaagtacgtccggtaggaacgggccgtaattccaacctagtcctaccgaacgtaacgaacctaaacgaccccaaaaggtaaacctaacctaactttacactacgaacctaaaatacgaaacctacctaggaacgtaccgttaggaacggtaaccgtacgggtacttaggtacctttaaagttacgttagggtacgacggtaaaggggaagggggtaacgtaacgtacgtaacgtaccgacgtacgacccg

SEQ ID NO: 323372 - DNA, 593 bp, Homo sapiens
  misc_feature: GZ8MTXP02JDF9S.51.6.A06.1.454.CMB.2.raw
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (542)..(542): a, c, t, g, unknown or other
  misc_feature (542)..(542): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtgganatgctattcgacccaaaccctnttattcttagttcggtaccagcagaacgccaggccagcccctgtgttgtgatatataaancactgagacgtccttagagggtactccctaggacgcgtatttcncgtcggccctccactacgaagggacaagtcggtacaacgtattacgactaagtcgaggtggacgtccgagacgaaggaagacgaggtcctagtacttattcgtacgtactaaacttcttacagtactatcgtagttagtacttagtgttacgtacggacgtacgggaaccgtaaggtccgtaaccgtcgttacggacccncgtaacccgaacgccccaaaccctcgtacgtaccaccgtttcgttcccccg

SEQ ID NO: 323373 - DNA, 624 bp, Homo sapiens
  misc_feature: GZ8MTXP02JJUCK.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgctattcgcccaacccacttattcttattggtaccagcagaagccaggccaggcccctgtgttgtgatatataaagcacgtgagaggccttacgagggtactcccgtgacgcgtattctctcgctccactcgaggacaagtcggtacactagttacgaaccagtccgaaggttacggagtacccgagggacaagggaaacgacggaacggccgtaggtaacttaacgttttctacgtactaaacttcctttacaacggtaactattccgaaggtttacggttactttaagtcgttacgtttacggaacgttacgggaaccgtaaaggtccgtacccgttacgtaacggtccgaacgacccgaacggtcccaaaccccgtacgtacgtaccctaccgtctttccccgg

SEQ ID NO: 323374 - DNA, 699 bp, Homo sapiens
  misc_feature: GZ8MTXP02F1EHX.51.6.A06.1.454.CMB.2.raw
  modified_base (259)..(259): a, c, t, g, unknown or other
  misc_feature (259)..(259): n is a, c, g, or t
  modified_base (300)..(300): a, c, t, g, unknown or other
  misc_feature (300)..(300): n is a, c, g, or t
  modified_base (334)..(334): a, c, t, g, unknown or other
  misc_feature (334)..(334): n is a, c, g, or t
  modified_base (350)..(350): a, c, t, g, unknown or other
  misc_feature (350)..(350): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagcgtggttttcctcgtgctctttaagaggtgtcagtgtcaggtgcagctggtgcaggtcgtgggggagcgtggtccagccgtggggacggtccctgagactctcctgtgaagcctntggattcagtcttcagtacgtagtggttgcgtctgggtccncaggctccgaggcaagggctgacgaggtggtgcntactatactcaattanaggaaagaaagactaaaataaaacttaccgtaacgacaacggtaaccgtacccggttaaggggaaaacggggccccgtaaatttacccgaaaccctagtttacccacccgtaaaaggaaacgtaaccaaaaaccgttcccccgaaaaaaacgtaaaccttaaacccgttaacttttaactaacctaacggtaaacgtaaaacgtaaaccgtaaaccgtaacccgtaacgtaacgtaacgtaaacgtaacggtaaccggtaccgtacgttacgttacgttaacgtttacgttacggtacggtacgggtaacgggtacgggtaacggtacgtacgtacgtacgacgtaacg

SEQ ID NO: 323375 - DNA, 577 bp, Homo sapiens
  misc_feature: GZ8MTXP02HYMGJ.51.6.A06.1.454.CMB.2.raw
  modified_base (373)..(373): a, c, t, g, unknown or other
  misc_feature (373)..(373): n is a, c, g, or t
  modified_base (444)..(444): a, c, t, g, unknown or other
  misc_feature (444)..(444): n is a, c, g, or t
  modified_base (460)..(460): a, c, t, g, unknown or other
  misc_feature (460)..(460): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggacggtccctgagactctcctgtgagcctctggattcagcttcagtacgtattgggtttgcgtcgtcggggtcccaccgaggcctcccgaagggccaaaggggtactgggctaggtggggtggcatctatatcatatggaaaggancaaataaactactacgacagactccgtagaacgggccgattcaccatcctaccaagagaacaacaccaaanaaccaactactttacnctagaccaaagtacaactacccagacgactacggaacgtacgacggtacctagtaccttaattacgttaggtacgacggaagggtagggaagtacgtacggtacttacaacgaccgg

SEQ ID NO: 323376 - DNA, 576 bp, Homo sapiens
  misc_feature: GZ8MTXP02INH0U.51.6.A06.1.454.CMB.2.raw
  modified_base (283)..(283): a, c, t, g, unknown or other
  misc_feature (283)..(283): n is a, c, g, or t
  modified_base (299)..(299): a, c, t, g, unknown or other
  misc_feature (299)..(299): n is a, c, g, or t
  modified_base (367)..(367): a, c, t, g, unknown or other
  misc_feature (367)..(367): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccatattcttatggtaccagcagagccagccagccctgtgttgttgatatataaanacatgagaggccttanagggatccctgagcgtattctctcggcctccacctcgagggacaatcgggtcactagttacgacctancgagtgggacgtccgagggaccaaggaaagtaccggagggcctaggaaccttatttctagtcaaagtcttacagacctatacgagtcggttaacttatacgttcgttacggacgtacgggaacctaaggtcccgaccgttaccgttacgggaccacggaaccctaaacggccccaaaaccccgaccgtgtacctacgtccttaccccgg

SEQ ID NO: 323377 - DNA, 743 bp, Homo sapiens
  misc_feature: GZ8MTXP02F17Y6.51.6.A06.1.454.CMB.2.raw
  modified_base (190)..(190): a, c, t, g, unknown or other
  misc_feature (190)..(190): n is a, c, g, or t
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcaggtcgtgggggagcgtggtccagccgtgggacgtcctgacgctctctgtgagcctntggattcagtcttcagtacgtatggttgcgcgtgggccncaggctcgaggcaagggctgcagggtgggtgctagtctatactcaatagtaggaaaaggaacactaaaataaaactaccgtaaccgactaaacggtacccgttccgggtaaggggaaaccgggggtacccgtaaactttacccgaaaccctactttaccccgtacccgaaacggtaaaccggaaacccttaaaaccctaccccgaaaaaaggaaacccctaaaccgttaacccgtttttaaacaccgtttaacggaaaaccctaaaaaacttccggaaaaccccttaccccgtaaaggtaacctaaacccggttaggggaaaccggggtaacctaaacgggggtctttaaccgggttactttaaacgttttacggttacgggttaccggtaacgggaaagggtaacgggggtaataaccgggttaacgtaacgtaccgaacgtacgg

SEQ ID NO: 323378 - DNA, 673 bp, Homo sapiens
  misc_feature: GZ8MTXP02FNFM9.51.6.A06.1.454.CMB.2.raw
  modified_base (191)..(191): a, c, t, g, unknown or other
  misc_feature (191)..(191): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtncagctggtgcaggtcgtgggggagcgtggtccaggccgtggggacgtcctgacgtctctcgtgtagaacgccctcgtggtacttcgagtcttacgaaggtacgttagttgggtttcgcgtccgtgggtcccaccgaggcctcccggaggaccgaaggggctgggacgaggggttgggacgctaacgttacgtaattatacgtaaatacggtaaggaaacggtaaacactaaaagtaaaacttaccgtaacgacgtaacgtaccgttacccgggagggaaccgggaccctattaccgaacctatacccgaaccgaaggtaaacaacctaaaacctacccaaaaacgtaactaaacctttaacctttagactaaccgaaataaacgtagaaaccctaccgtaggactacgtaggacgaacgtcggacttagtacttaagttcgtaggacgacggaaggacggactacgacgtacacgacgaacg

SEQ ID NO: 323379 - DNA, 633 bp, Homo sapiens
  misc_feature: GZ8MTXP02HCR8W.51.6.A06.1.454.CMB.2.raw
  modified_base (156)..(156): a, c, t, g, unknown or other
  misc_feature (156)..(156): n is a, c, g, or t
  modified_base (311)..(311): a, c, t, g, unknown or other
  misc_feature (311)..(311): n is a, c, g, or t
  modified_base (507)..(507): a, c, t, g, unknown or other
  misc_feature (507)..(507): n is a, c, g, or t
  modified_base (573)..(573): a, c, t, g, unknown or other
  misc_feature (573)..(573): n is a, c, g, or t
  modified_base (612)..(612): a, c, t, g, unknown or other
  misc_feature (612)..(612): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttccncgttgctcttttaagaggtgtccagtgtcaggtgcagctggtgcaggtcgtgggggagcgtggtccaggcctggggaggtccctgagactctcctgtgaacgcctcgtggtattcagtcttcgaggttacgtagtggttgcgcgtcggggtcccncgaggcctaccgaggacgaacgggctgggaccgtagggtcggggtcgacattactagtactcaagttagaggaaaaggagtactaaaattaaactacgtacgcaaggacctcggtaaggaacgggtcccgtataccacctatccgtaccgaaggaacaaacctaaacacccgaaaagaccctaaacttactttaanacgtacgaaactaaacgtacgaacccaccgtaggaacgtaccgttaggaacggtaccgtaccggtnttaacgttactagttagtcgtaggacgtaaggaaggganacgtacgactacgaacgtacg

SEQ ID NO: 323380 - DNA, 557 bp, Homo sapiens
  misc_feature: GZ8MTXP02FSC2Q.51.6.A06.1.454.CMB.2.raw
  modified_base (296)..(296): a, c, t, g, unknown or other
  misc_feature (296)..(296): n is a, c, g, or t
  modified_base (326)..(326): a, c, t, g, unknown or other
  misc_feature (326)..(326): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (428)..(428): a, c, t, g, unknown or other
  misc_feature (428)..(428): n is a, c, g, or t
  modified_base (442)..(442): a, c, t, g, unknown or other
  misc_feature (442)..(442): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggagcgtggtccagcctgggaggtccctgagctctctgtgaagcctctggattcagcttcagtacgtatggttgcgtcgtgggtccncgaggctccaggcaagggctgcaggtgggngcatctatatcatagtgaaagancaaataaatctacgnagaccgtcgtagaaggccgtatcacatcaccaagacgacaactaccaaagaaccactactttanctacgaactaaacngaaacccaccgtaagagtaaccgttggaacggaaccgacggtcttacgtacgttactttacgttagacgtaggaaaggtacgggagtaaacgttccgaaagtcccaacggaaccg

SEQ ID NO: 323381 - DNA, 625 bp, Homo sapiens
  misc_feature: GZ8MTXP02FZUXK.51.6.A06.1.454.CMB.2.raw
  modified_base (461)..(461): a, c, t, g, unknown or other
  misc_feature (461)..(461): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctcgtggagatgcattcgacccaaaccctattattcttattcggtaccagcagaacgccaggccacggcccctgtgttgttgatatataaagacactgagaggccttcgaggtactcccgtaggacgcgtattctcgtcggcctcccactcgaacgggacaagtggtacactagttcgaacctatcgaggtgacgtccgaggacgaaggaaagacgaggctaggtacttatttcgtagtactaagttctttanagtaccaatccgtaggttagttaccgtttaagtcgttacgtttacgggtaacgtacggggaacctaacgggtcctaaccggttacgtacggttaccgacgtaaccccgaaacggaccccctaaaacccgtccgtacgtacccgtaacgttcccgtttcccccgg

SEQ ID NO: 323382 - DNA, 550 bp, Homo sapiens
  misc_feature: GZ8MTXP02JC38T.51.6.A06.1.454.CMB.2.raw
  modified_base (258)..(258): a, c, t, g, unknown or other
  misc_feature (258)..(258): n is a, c, g, or t
  modified_base (298)..(298): a, c, t, g, unknown or other
  misc_feature (298)..(298): n is a, c, g, or t
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (421)..(421): a, c, t, g, unknown or other
  misc_feature (421)..(421): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtctgggggaggcgtggtccagccgtgggaggtccctgagctctcctgtgaagcctntggattcagtcttcagtacgtatggttgcgcgtgggtccncgaggcctccgaggcaagggctgcaggtgggtgcatcatatcatagtgaaaggaancaaataaactactacgnagactcgtagaggcatcacatcncaganacactccaaagacactacttanctagacaaatcgaacaccgtagacgtacgttagacggtaacgacggtacttacgttacttaacgtttacgttacggtaggaccggaaagggaacggggaagtaacgtccggtaaatccgaacgaaccgg

SEQ ID NO: 323383 - DNA, 562 bp, Homo sapiens
  misc_feature: GZ8MTXP02FI569.51.6.A06.1.454.CMB.2.raw
  modified_base (191)..(191): a, c, t, g, unknown or other
  misc_feature (191)..(191): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggtttttcctcgttgctcttttaagaggtgtccagtgtcaggtncagctggtgcagtcgtgggggagcgtggtccagccgtgggacgtccctgagactctccgtgtgacgcctcgtggtattcagcttcgagtacgtagttggtttcgcgtcgtgggtcccgccaggcctccgaggcgaaggggactgcgaggtgggtgcgatctatagtcatagtagaagagacaaagtaaatactacgatacgacctcgtagaacggcccgtattccactactcactagacgaacaacacccaaagaccaactacttactctagaactaaatacaacacctagagacgttagacggacacggtactcgtactacgttagttagcggtacgaaggtaggacgtacgtaccgactacacgaaccg

SEQ ID NO: 323384 - DNA, 647 bp, Homo sapiens
  misc_feature: GZ8MTXP02H7MSS.51.6.A06.1.454.CMB.2.raw
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcagggtncagcgtgggtncgaggtcggtggggggagcggtggtccaggccgttgggggacggttccctggacgtacctctccgtggtacgaacgtccctcgtggattcagtcttcgagttacgtagttggttgccgtcgtgggcccgccgaggcctccgaggtcgaaggggactggcgaggtgggtgactatacgtatagtctaatagtagaaaggaatacaaaattaaaactacgtacgacgtaacgacttacgacggtaacgggaccgtactacgacccacgttacctacgaaacgaacgaaactaacccgtaaaccaaaacgaacctaaacctaactttaactacttaagaacctaaaactaacgtaaacccaacccgtagaacgtacgtacggaacggtacgacggtctagtacttatacgttgtgtacggaagaggagtacacggtacacgacgacg

SEQ ID NO: 323385 - DNA, 657 bp, Homo sapiens
  misc_feature: GZ8MTXP02GXT6Z.51.6.A06.1.454.CMB.2.raw
  modified_base (349)..(349): a, c, t, g, unknown or other
  misc_feature (349)..(349): n is a, c, g, or t
  modified_base (600)..(600): a, c, t, g, unknown or other
  misc_feature (600)..(600): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggagtccctgagactctctgtgacgcctctggattcagtcttcagtacgtagttggttgccgtcgtgggtcccgccgaggcctccgaggcaaggggctggctaggtgggtgcagtctaatntacagtataggaaaggaagctaaaataaactacgtacgacgtaagtaccgtaccgtaggaacggggtaccctagttaccaacctagtacctacccgaagaacgaaccaaaaccgtaccccaaaagtaaaccctaaaccttaccttttaacaccttagaacctaaaacttacggaaaccctacccgtagaacgtaaccgttaggaacggtacctacgggtacttacggttaccttaaagtttagttaccggnggtaaccggaaagggtacgggtaagtaacgttaccggaactaccgaaacgaacccgg

SEQ ID NO: 323386 - DNA, 718 bp, Homo sapiens
  misc_feature: GZ8MTXP02II3T7.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgccagtgtcaggtgcagctggtgcagtcgtgggggagcgtggtccagccgtgggagtccctgagctctcctggtgacgcctcgtggattcgagtctttacgaggtttacgtattgggtttcggccgcgttcggggtcccgaccgaggcctacccggaggacgaaacggggcttggcgtagggtggggtacggcctattacgtaatactactaagtttagaaggtaaacgggacaaccgtaaaataaaacggtaacctaggacctaacggaccgttaccgggtacgggaaacgggggacccttaacgttacccaaccgtaacttacccgaccaacgggaaacctaacaaaacccgttaacccaaaaacggtaaccctaaactttaacccgtttaactaccgttacgaaaacctaaacgttaaccgaaaaccctacccgtaggaaacggttaccgttacggaacggaacccggtacggtcttacggtaacttagtttaagttcgggagtacggaaggaacggtagaacggtcacgtacagtacccg

SEQ ID NO: 323387 - DNA, 670 bp, Homo sapiens
  misc_feature: GZ8MTXP02GZRHP.51.6.A06.1.454.CMB.2.raw
  modified_base (306)..(306): a, c, t, g, unknown or other
  misc_feature (306)..(306): n is a, c, g, or t
  modified_base (377)..(377): a, c, t, g, unknown or other
  misc_feature (377)..(377): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcaggtcgtgggggagcgtggtccagccgtggggacgtcctgagactctctgtagacgtcctgtggtattcagtctgagttacgtagttggttgcgtcgtcgggtccncgaggcctacgaggacgaagggctggcgagggtgggtgactatactatagtactaatagtaggaaaggaanactaaaattaaactaccgactacgaacgtaccgtacggtacgaacgggtacccgtataccgaacctactaccgtaccaaggaaacgtaaacaactaacccgaaaagaaccctaacttaactttaacgtaccttagaaaacctaaacgtaacctaaaccgtacccgtaaggtaaacgtacgtttaagggaaaccggtacggtaccggttacttacgttaacgtttacgttagtttacggaggtacgggtaagggtaaggggtacgaaacgttacggtactaaccgaacgaaccg

SEQ ID NO: 323388 - DNA, 578 bp, Homo sapiens
  misc_feature: GZ8MTXP02FO5KU.51.6.A06.1.454.CMB.2.raw
  modified_base (255)..(255): a, c, t, g, unknown or other
  misc_feature (255)..(255): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtggggggagcgtggtccagcctgggagtccctgagctctctgtgagcctntggattcagcttcagtacgtattggtttgcgctgggtcccgcaggcctcgaggcgaaggggctgcgaggtgggtgctatctatatcaatagtaggaaaggaagcctaaaagtaaaactacctaacgcaagtaccgtccggtagaacggggcccgtaattccgaacctactacctcccgaagaacgaacaaactaccccaaaagtaaaccaactacgtttatactagaactaaatcgaaaccaccctgagtacttggaacggtacacggtctgtacttattacgtagtcgtaggaacgtaggggactagtacgactcgacgacg

SEQ ID NO: 323389 - DNA, 666 bp, Homo sapiens
  misc_feature: GZ8MTXP02INRFU.51.6.A06.1.454.CMB.2.raw
  modified_base (255)..(255): a, c, t, g, unknown or other
  misc_feature (255)..(255): n is a, c, g, or t
  modified_base (425)..(425): a, c, t, g, unknown or other
  misc_feature (425)..(425): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctcccctctcactctctgcacaggctctgacgcctctatgtgctgacacacgccacccgtcggtcgtccgtgtccccaggacacgacggcaggatcacctgctcgtgganatgctattcgaccctaaaccacttaattccttattacggtaaccagacaacgaagcccaggcccacggtccccttaggttgttacggttagaacttagtaaagtaaaggacctaacgtaggaacgaacggtccttacgaacggggtactcccgtagacgcgtaactttcncgtacggcccttacccacgttaccggaggtactaagtcggtacactaagttcaacctatcgaaggtcgacgtcgaggacagtaacgacggacggactcggaaacttcggtttcaacggttactaaaacgtttcccgttaaacgtaaacgtacgttacgttacgtaacggtttacgttaacgtttaacggttaccgtttaaccggtaacggttaccggtaaaccgggtaaccgttaaaccgg

SEQ ID NO: 323390 - DNA, 649 bp, Homo sapiens
  misc_feature: GZ8MTXP02IO8GA.51.6.A06.1.454.CMB.2.raw
  modified_base (116)..(116): a, c, t, g, unknown or other
  misc_feature (116)..(116): n is a, c, g, or t
tcagcgatcgtatacacgaccggtgctcgatttagatctactgacagggcacgaccggtgctcgatttagatctactgacagggggctgtgggtccaggaggcagaactctgggtntctcaccatggcctggatccctctacttcctccccctctcactctctgcacaggctctgacggtcctcctatgtgctgacacacgcccaccgttcggtcgtcccgtcgtccccagtacacggacggcaggtactccacctgctcgtggagatgctattcgacccaaccctacttacttacttattacggtaccagacgaagaacgccgacggccacggcccctgtgtttgtgtaatataaataaagtaccacgtgaacgtacgtccttacggacggtccttccgtaggacgtacgttacttcgtccgttcggtccctaccaccgttacggaagggtaaacctaaagtcggtacctaagtacgtttacgaaccgtatacgaggtacggtacgtaccgaggaaccgaaaggaaacgacggacggtactaacggttactttaacgttcgtaacttactaaactttcaacgtacactagttacgtagttagttaacttagttacgttacgtaacggtacgtacggtacgtaaaccgg

SEQ ID NO: 323391 - DNA, 599 bp, Homo sapiens
  misc_feature: GZ8MTXP02ICV4T.51.6.A06.1.454.CMB.2.raw
  modified_base (189)..(189): a, c, t, g, unknown or other
  misc_feature (189)..(189): n is a, c, g, or t
  modified_base (300)..(300): a, c, t, g, unknown or other
  misc_feature (300)..(300): n is a, c, g, or t
  modified_base (367)..(367): a, c, t, g, unknown or other
  misc_feature (367)..(367): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcagtcgtgggggagcgtggtccagcctgggacgtccctgagactctcctgtgaagccctctggattcagtcttcagtacgtatggttgcgtcgtgggtcccncgaggcctaccgaggcgaaggggctggcgaggtggggtgctatctaatatcatagtaggaaaggaanactaaaataaactacgtacgacacgacctccggtagaacgggccgattaccaccactctaccaagacgaacactaacccaaacgaaactaacctaacttttactactagaactaaagtacgaaacctacccgtagaacgtacgtaggaacggacgtacggacttacgttacttaagtttacgtttggtaggacgggaaggtagggaagacgttacgacgtaccgaacgtacg

SEQ ID NO: 323392 - DNA, 554 bp, Homo sapiens
  misc_feature: GZ8MTXP02HRML2.51.6.A06.1.454.CMB.2.raw
  modified_base (155)..(155): a, c, t, g, unknown or other
  misc_feature (155)..(155): n is a, c, g, or t
  modified_base (198)..(198): a, c, t, g, unknown or other
  misc_feature (198)..(198): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (448)..(448): a, c, t, g, unknown or other
  misc_feature (448)..(448): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttccncgttgctcttttaagaggtgtccagtgtcaggtgcagctggtncagtctgggggagcgtggtccaggcctgggagtccctgagactntcctgtgaagcctntggattcagcttcagttacgtatggttncgntgggtccnccaggctccaggcaagggtctgcaggtgggtgcatctatatcagtatgaaacggtaagctaaattaaactactacgacagaccttccgggagaacgggccgattacactatacctccaagagaccaaactacccaaagaaactactactttanactacgaacaagtacgaaccaccgtgacgtacgtgacggacacggtctacgtacgttattacgttcgtagacgaaggtacggtaagacgtacggactcacggaacg

SEQ ID NO: 323393 - DNA, 530 bp, Homo sapiens
  misc_feature: GZ8MTXP02JZBS4.51.6.A06.1.454.CMB.2.raw
  modified_base (155)..(155): a, c, t, g, unknown or other
  misc_feature (155)..(155): n is a, c, g, or t
  modified_base (442)..(442): a, c, t, g, unknown or other
  misc_feature (442)..(442): n is a, c, g, or t
  modified_base (517)..(517): a, c, t, g, unknown or other
  misc_feature (517)..(517): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttccncgttgctcttttaagaggtgtccagtgtcaggtgcagctggtgcagtctgggggagcgtggtccagcctgggagtccctgagactctcctgtgaagcctctggattcagtcttcagtacgtatggtttgcgtcgtgggtccgccgaggctccgaggcaagggctgcaggtgggtgcagtctatatcatatgaaaggaagcaaaagtaaactactacgacagactccggtagaacgggccgattcacctatccaccagagacaacgtacccaaagaacactactttanctagacaaatacgaacacccgtagacgtactaggacgacacggctcgtacttattacgtcgtgacgaaggagganatcgatcgacacg

SEQ ID NO: 323394 - DNA, 731 bp, Homo sapiens
  misc_feature: GZ8MTXP02JGP5I.51.6.A06.1.454.CMB.2.raw
  modified_base (214)..(214): a, c, t, g, unknown or other
  misc_feature (214)..(214): n is a, c, g, or t
  modified_base (463)..(463): a, c, t, g, unknown or other
  misc_feature (463)..(463): n is a, c, g, or t
tcagcgatcgtatacacgaccggtgctcgatttagatctactgacagggggtgggtccaggaggcagaactctgggtgtctcaccatggcctggatccctctacttctccccctctcactctctgcacaggctctgaggcctcctatgtgctgacacagcccaccctcggtgtccgtgtccccaggacagacgccaggatcacctgctctgganatgcattcgacccaaccatattcttattggaccagcagaagcaggccaggcccctgtgttgttgatatataaagacactgagaggccttcgagggtactccctggagacgattctcgtccggcctccaccttacgagggactagtcggacacattacgacatcgagtcggagtacccgaagggcgaaggaaacgcggaacggtaccgtagtaaccgttattttaccgtaggttacctaaacttctttanacggtaacgtattaaccgtaggtttacggggtttaaacctttaggttaccgtttaccgggtttaaccggtaaaacgggtttaccggggaaaacccgggtaaaccgggttacccggttaaacccccggggttaccccgtttaaacgggggtaccccgtaaacccggtaaacccccgggtaaaacccgggggtaccccccaaaaaccccccgttcccggtttaaccgggtacccccgtaaaccccttttccccggtttaacccccccggg

SEQ ID NO: 323395 - DNA, 659 bp, Homo sapiens
  misc_feature: GZ8MTXP02H6LT3.51.6.A06.1.454.CMB.2.raw
  modified_base (542)..(542): a, c, t, g, unknown or other
  misc_feature (542)..(542): n is a, c, g, or t
  modified_base (564)..(564): a, c, t, g, unknown or other
  misc_feature (564)..(564): n is a, c, g, or t
  modified_base (594)..(594): a, c, t, g, unknown or other
  misc_feature (594)..(594): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcgagtcgtgggggagcgtggtccagccgtggggacgtccctgagtacctcttccgtgtgaacgtccctcgtggtattcaggtccttcgtaaggttaccgtagttggttttcgccggtccggttggggtccccgccgagggcctacccggaggaccgaaaggggtcctgacgtagggtggggtggacctagttctatacttactaagtagtaggaaaaggaaacgtacgtaaaaattaaaactaccgtaaccgaactaacggaacgttacccggtaggaacggaccgtaattaccaccattccaccaagacgaaccaacacccaaagaaacctacttactttancgttaagactaaatcgaaaccnccctagacgtaacgtacggacgactacggnttaccgttataagtttctcggttagacggtaaggaggggtactacgtacgacgtacaacggaccg

SEQ ID NO: 323396 - DNA, 662 bp, Homo sapiens
  misc_feature: GZ8MTXP02HD6BH.51.6.A06.1.454.CMB.2.raw
  modified_base (315)..(315): a, c, t, g, unknown or other
  misc_feature (315)..(315): n is a, c, g, or t
  modified_base (340)..(340): a, c, t, g, unknown or other
  misc_feature (340)..(340): n is a, c, g, or t
  modified_base (616)..(616): a, c, t, g, unknown or other
  misc_feature (616)..(616): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccacggccgtgggacggtccctgacgactctccgtgtgaacgcctcgtggtattcagtcttacgagtacgttgtggtttgcgtcgtcgggtcccnccgaggcctaccgaggacgaaggcnggacgaggtcgggtgactagtactagtactcgtaatagtacggaaaaggtaacgactaaaaagttaaaactccgtaaaccgactacggaaaccgtccgggtaaagggaacgggcccttaaactacccaacctaactaccgtaccgaaacggtaacgtaaaccaaaccctaacccgaaaacgtaaccttaaaccttactttaataccaggtaaactaaacgtacgtaaccaaccgttggaacgtacgtaggaacgtaacgcgttctacgttaacctntacgtataccggtgaacggaggtaacggatacgtacgataccgacg

SEQ ID NO: 323397 - DNA, 810 bp, Homo sapiens
  misc_feature: GZ8MTXP02H7G23.51.6.A06.1.454.CMB.2.raw
  modified_base (199)..(199): a, c, t, g, unknown or other
  misc_feature (199)..(199): n is a, c, g, or t
  modified_base (272)..(272): a, c, t, g, unknown or other
  misc_feature (272)..(272): n is a, c, g, or t
  modified_base (378)..(378): a, c, t, g, unknown or other
  misc_feature (378)..(378): n is a, c, g, or t
  modified_base (402)..(402): a, c, t, g, unknown or other
  misc_feature (402)..(402): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtncgagtcgtgggggaggcgtggtccaggccgtggggacggtccctggacgtctctcctggtagaacgtccctgnggtattcagtcttcagttacgtagttgggtttgccgtcgtcgggtcccgccgaggcctaccgaggccgaaagggtctgggcgtagggtggggtcgactagttctanagtcaagtagtaggaaaaggtaanacctaaaattaaaactacctaaaccgactaaacggtaccgtacgggtaaacgaaacggggtacccgtaacttacccaacccctaagtttacccccgtaaccgaaaacggtaaaccgaaaaccttaaacccgtaaaacccccgaaaaacggaaaaccccttaacctttaaaacccgtttttaacacccgggtttaaaacgaaaacccttaaaaacgtaaaccccgtaaaacccgtaacccggtaaggtaaaacccggttaaaggtaaccggggaaaaccgggttaacccggtaaccggggttactttacgtttaaacgtttaacgtttaggttaccggtaacggggtaacgggaaggggtaacgggtaaacgttaaccggtacgtaaaccgtaaccgaaaccgtaccgg

SEQ ID NO: 323398 - DNA, 596 bp, Homo sapiens
  misc_feature: GZ8MTXP02IBMI9.51.6.A06.1.454.CMB.2.raw
  modified_base (359)..(359): a, c, t, g, unknown or other
  misc_feature (359)..(359): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtgcagtcgtgggggagcgtggtccagcctgggagtccctgagactctcctgtgaagcctctggattcagtcttcagtacgtatggttgcgtcgtgggtcccgccaggctcccgaggcgaaaggggctgcaggtgggtggcatctatatcatatgaaaggaanacaaataaactacgtacgacacgacgtccgtaggacggaccgtataccaccacgtacctaccgaagaacgaaaccaaacctaacccgaaaacaaacctaaccttaaactttactactacgaactaaaacgtacgaaaccaccgtagacgtaacgtagaacgtacgacggtctagttacttagtttacgttaggtacggacggaagggtaagggagtacgtacgtactacgaacgacg

SEQ ID NO: 323399 - DNA, 591 bp, Homo sapiens
  misc_feature: GZ8MTXP02IHNZ7.51.6.A06.1.454.CMB.2.raw
  modified_base (256)..(256): a, c, t, g, unknown or other
  misc_feature (256)..(256): n is a, c, g, or t
  modified_base (375)..(375): a, c, t, g, unknown or other
  misc_feature (375)..(375): n is a, c, g, or t
  modified_base (442)..(442): a, c, t, g, unknown or other
  misc_feature (442)..(442): n is a, c, g, or t
  modified_base (464)..(464): a, c, t, g, unknown or other
  misc_feature (464)..(464): n is a, c, g, or t
  modified_base (476)..(476): a, c, t, g, unknown or other
  misc_feature (476)..(476): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtcctgagactctctgtgacgcctntggattcagcttcaggtacgtatggtttagcgtacgtggggtcccaccgaggcctaccgaggcaaaggggctggacagggtggggtcgcctatcgtatatcagtaagtggaaaggacanaaataaatacgtaacgcagtacttccgagaacgggccattccaacatcgtcccaaggactaacaacncaaagaaaccactacgtttacnctacaactaaanacgaacacccttagaacggtacttaagggaccgaaacgacgggttacgttacgttacttaagttacgttacggtaggacggaagggacggtacgtacgtacgacgtacgacgacg

SEQ ID NO: 323400 - DNA, 746 bp, Homo sapiens
  misc_feature: GZ8MTXP02GVI3X.51.6.A06.1.454.CMB.2.raw
  modified_base (191)..(191): a, c, t, g, unknown or other
  misc_feature (191)..(191): n is a, c, g, or t
  modified_base (311)..(311): a, c, t, g, unknown or other
  misc_feature (311)..(311): n is a, c, g, or t
  modified_base (350)..(350): a, c, t, g, unknown or other
  misc_feature (350)..(350): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcagggtncagctggtgcaggtcgtgggggaggcgtggtccaggccgtggggacgtccctgacgtactctcgtgtgaacgcctgtggattcagtcttcagtacgtagtggttgcgtcgtcgggtcccncgaggcctacgaggacgaagggtctggcgaggttggggngacctagttctaatagtactagtaagtaggaaaagggtaatacgtaaaaattaaacgtaccgtaaccgacgtaacggtaacccgttacccggtaagggaaaccgggaccctaattcccgaaaccctacgttccgaaccccgaagaaccgaaaccaaaccttaaccccgaaaagtaaccctaaaccgttaaccctttttaagcccgttaacgaaacctaaaacgttacgaaacccctaacccgtagggtaacctaaccgttagggaaaacgggtaccctaaaacccgggtttactttaaccgttaacgtttaacggtttacggttacggtacgggaaacggtaaaggggtaaacggtaaacgttacgtaacggtaaccgtaaccgtaaacgtaaccg

SEQ ID NO: 323401 - DNA, 679 bp, Homo sapiens
  misc_feature: GZ8MTXP02IYB69.51.6.A06.1.454.CMB.2.raw
  modified_base (254)..(254): a, c, t, g, unknown or other
  misc_feature (254)..(254): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctcccctcctcactctctgcacaggctctgaggcctcctatgtgctgacacagcccaccctcggtcgtccgtcgtccccaggacagacggcaggatcacctgctctgganatgcattcgacccaaccctactattcttattggtacccagcaagagccaggccaggcccctgtgttgttgattataataaacgacacgtgagacggtaccttacgaggggactcccgtaggacgtccgtattcctcgtcgggaccttcccgacccttacgaacgggaacaacgttcggtcaaacgtattacgaccctagtaccgtaaggttacggacgttccgaacggcgaaacgaaacggtaccgggacggtacccgtaggtaaaccttgtttttacccgtagttacccgtaaaatttcccgttacctaaaggtaaaccctagttaaacccgtagggtttacggttaaaccctttttaagtcggtttacccgtttaccgggtaaaaacccggtcggggtttaaaacccccgtttaaaaccgggg

SEQ ID NO: 323402 - DNA, 652 bp, Homo sapiens
  misc_feature: GZ8MTXP02JS4RB.51.6.A06.1.454.CMB.2.raw
  modified_base (190)..(190): a, c, t, g, unknown or other
  misc_feature (190)..(190): n is a, c, g, or t
  modified_base (325)..(325): a, c, t, g, unknown or other
  misc_feature (325)..(325): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
  modified_base (520)..(520): a, c, t, g, unknown or other
  misc_feature (520)..(520): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtncagctggtgcaggtcgtgggggaggcgtggtccaggcccgtggggacggtccctggacgtactctccgtgtagaacgtccctctggattcagtccttacgagttacgtattgggtttcgcgtcgttggggtcccnccgaggcctccgaggcaaaggggctgcgtaggtgggngctatctatactcatagnggaaagganactaaaataaactacgtacgacaacggtaccgtacggtaggaacggggtcctaacttaccaacctatacccgtaccgaaaggaaccaaaccaaacctaacccgaaaacgtaaaccctaacttaactttaanaccttaggaaacctaaactacgaaaccctaccgtagacgtaacgtacggaacgtaccgtacggtctacggttacttaagttacgttacggtagacggtaaggaagggtaactcgtacgactaccgacgtacg

SEQ ID NO: 323403 - DNA, 519 bp, Homo sapiens
  misc_feature: GZ8MTXP02H7VA2.51.6.A06.1.454.CMB.2.raw
  modified_base (254)..(254): a, c, t, g, unknown or other
  misc_feature (254)..(254): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaaccatattctatgtaccagcagancaggccagccctgtgtgtgatatataaagcactgagaggcctttcgagggactccctgagcgtattcctctcggctccacctcgagggacaaagtggtacactattagaccaatcagttggagtccaggcagaacgacgaggctgatatttctgtactaatcttacagacatcagttagtacttatacgtcttacggaacttcggggacctaaaggtcctaacgtcctagtcaacgcccgaacgacccaacccactcgtactacg

SEQ ID NO: 323404 - DNA, 669 bp, Homo sapiens
  misc_feature: GZ8MTXP02HS66S.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagcctgggagtccctgagctctctgtgaacgcctcgtggattcagtcttcagttacgtagttggtttgcgtcgtcgggtcccgaccgacgggcctccgaggaccgaaggggtactggcgtaggtggggtcgacctagtactagtactactagtagtacggaaaggtaacgtactaaaattaaaactaccgttaacgaccaaacgggtaccttacccgggtaagggaaacgggtacccgtatttaccgaaccctattaccctaccgaacgaacgaaccctaaacctaaccccgaaaactaacctaaaccttacttttacacttacggaaactaaacgacgaaaccctacccgtagaacgtacgttacggaacgaccggtacgtacgtacgttctttacgttacgtcgtaggacggaaggaggtaagtacgtacgtacgaccgacgaccgg

SEQ ID NO: 323405 - DNA, 629 bp, Homo sapiens
  misc_feature: GZ8MTXP02FXY9G.51.6.A06.1.454.CMB.2.raw
  modified_base (139)..(139): a, c, t, g, unknown or other
  misc_feature (139)..(139): n is a, c, g, or t
  modified_base (333)..(333): a, c, t, g, unknown or other
  misc_feature (333)..(333): n is a, c, g, or t
  modified_base (365)..(365): a, c, t, g, unknown or other
  misc_feature (365)..(365): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctntacttctccccctctcactctctgcacaggctctgaggccttctatgtgctgacacacgcccacctggtcgtccgtcgtccccaggacagacggccaggatcacctgctcgtggagatgcattcgaccaaccctacttattcttagtgtaaccagcagagcacggccacggcccctgtgttgtgatataataanacactgagaggtcctagaggtctccgtggacncgtattctcgtgtctaccactcgaggacaagttcgtacaattatacgaacctagtaccgaggttacggagtacccgaagggaacgaaaggaaacggacggaacggtacgttacggaacttttaactttcgttaacggttaacgtaaacttttaccggttaaccgtaaagtaacctacgtttaaccggtaggttaacggttaaacctttagttacggtttaccgttacgggtaaaaccggttacgggaacccggtttaaaccggg

SEQ ID NO: 323406 - DNA, 685 bp, Homo sapiens
  misc_feature: GZ8MTXP02G045C.51.6.A06.1.454.CMB.2.raw
  modified_base (158)..(158): a, c, t, g, unknown or other
  misc_feature (158)..(158): n is a, c, g, or t
  modified_base (192)..(192): a, c, t, g, unknown or other
  misc_feature (192)..(192): n is a, c, g, or t
  modified_base (321)..(321): a, c, t, g, unknown or other
  misc_feature (321)..(321): n is a, c, g, or t
  modified_base (501)..(501): a, c, t, g, unknown or other
  misc_feature (501)..(501): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatgggagtttgggctgagcgtgggttttccncgttgctcttttaagaggtgtccagtgtcaggtncagctgggtgcaggtcgtgggggaggcgtggtccaggccgtggggacgtccctggacgactcgtcctgagaacgccctgtggattcagtccttacgagttacgtagttgggttgcgtcgtagggtcccnccgaggcctcgaggcgaagggtctggcgaggtgggtcgctagtctatatcaattgaacggaaaagagacctaaaattaaacgtaccgtacgaccgtaagaccgttaccgggtaagggaacggggaccctattacccaactacgttaccaccgaagaacgaaaccaactaacccgaaaaanaacctaacttactttaacactaacgaaactaaacgtaccgaaaaccgtaccgtaaggtaccgtaacggtaacggaaacggtaccgtacggtacgttacgttaacttaacgttaggtacggtaacggggaacggtaaggggtaaacgggaacgttaacggtacgtaaccgtacgtaacgaacccg

SEQ ID NO: 323407 - DNA, 597 bp, Homo sapiens
  misc_feature: GZ8MTXP02HX60O.51.6.A06.1.454.CMB.2.raw
  modified_base (260)..(260): a, c, t, g, unknown or other
  misc_feature (260)..(260): n is a, c, g, or t
  modified_base (333)..(333): a, c, t, g, unknown or other
  misc_feature (333)..(333): n is a, c, g, or t
  modified_base (580)..(580): a, c, t, g, unknown or other
  misc_feature (580)..(580): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtggggggagcgtggtccaggcctgggacgtccctgagactctcctgtgaagcctntggattcagtcttcagtacgtatggtttgcgcgtggtcccgcgaggctccaggcgaagggctggcgagtgggngcatctatatcatagtagaaacggagactaaagtaaaactacctacgacgacgtaacgtcccggtaggaaacggtcccgaattaccaaccgtacttaccctaccgaagaacgaaccaaactacccgaaagaaacctaacctaactttaataccttagaacctaaaacgtcgaaacctaccccgtagaacgtacgtaggaacgacgacggtactgtacttattacgtcgtgacgtaaggaggtaacgngtacgacgtacagaccg

SEQ ID NO: 323408 - DNA, 682 bp, Homo sapiens
  misc_feature: GZ8MTXP02GR81S.51.6.A06.1.454.CMB.2.raw
  modified_base (195)..(195): a, c, t, g, unknown or other
  misc_feature (195)..(195): n is a, c, g, or t
  modified_base (368)..(368): a, c, t, g, unknown or other
  misc_feature (368)..(368): n is a, c, g, or t
  modified_base (439)..(439): a, c, t, g, unknown or other
  misc_feature (439)..(439): n is a, c, g, or t
  modified_base (461)..(461): a, c, t, g, unknown or other
  misc_feature (461)..(461): n is a, c, g, or t
  modified_base (485)..(485): a, c, t, g, unknown or other
  misc_feature (485)..(485): n is a, c, g, or t
  modified_base (651)..(651): a, c, t, g, unknown or other
  misc_feature (651)..(651): n is a, c, g, or t
  modified_base (675)..(675): a, c, t, g, unknown or other
  misc_feature (675)..(675): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttggggttttcctcgttgcttcttttaaggaggtgtccagtgtcagggtncagcgtggtgacgtaggtcggtgggggggaggcggttcgggtcccaggtcccgtgggggacggtcccgtggaacgtccttcctccgtggtagaacggcccttcgtggtaacttcgaggtcctttacgacggttacggttagttcgggtttcgccggtcggttcggggtccccnccggaggtccgtcgaagggaccgtaaaggggcttgggcgtaggggttgggtcggactagttctaagtactntaagttagtaggaaaacggaanactaaaataaaactacgtaccganaacgtacgttccggtaacgggaacgggtcctaactccaacctactccaaccgaagacgaaaccaactaacccaaataaccacttaacgttatccagaacctaaagtaccaaacctaccgtagaactacgtaggaacgtacgcgtacttagtacttaatttacgtgnggtaagaagaggataacgctaacncgacacg

SEQ ID NO: 323409 - DNA, 679 bp, Homo sapiens
  misc_feature: GZ8MTXP02GOE4T.51.6.A06.1.454.CMB.2.raw
  modified_base (259)..(259): a, c, t, g, unknown or other
  misc_feature (259)..(259): n is a, c, g, or t
  modified_base (300)..(300): a, c, t, g, unknown or other
  misc_feature (300)..(300): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttctttttaagaggtgtccagtgtcaggtgcagctggtgcaggtcgtgggggagcgtggtccaggccgtgggacgtccctgagctctctgtgagctntgattcagtcttcagtactattggttgcgcgtcgggtcccncgaggcctcgacggcgaagggactggcgagggtgggtcgctatctaatatcaataagtaggaaaggtaagactaaaataaacttaccaacgacaacgtaccgttacccgggtaagggaaaccgggtacctaacttaccgaaccctaacttcctacccgaacgaacgaaacctaaacctacccgaaaactaacctaaaccttaacttttacgacttaacgaaacctaaaacgtaccgtaaaccctaaccccgttaggaacgtaacgttaacggaacgggtaaaacccgtcggtacgttacgttaaccgtttaagtttacgttggtacggaacggggtaaggaaggggtaccgtaagtacgtacggtacaaacgggaaccg

SEQ ID NO: 323410 - DNA, 666 bp, Homo sapiens
  misc_feature: GZ8MTXP02HJIXR.51.6.A06.1.454.CMB.2.raw
  modified_base (192)..(192): a, c, t, g, unknown or other
  misc_feature (192)..(192): n is a, c, g, or t
  modified_base (394)..(394): a, c, t, g, unknown or other
  misc_feature (394)..(394): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttggggttttcctcgttgcttcttttaagaggtgtccagtgtcaggtncagctggtgcaggtcgtgggggagcgtggtccaggccgtggggacgtccctggacgtacctctcctggtagaacgccctgtggattcagtcctttcaggttacgtattggtttgccgtcgtgggtcccaccgagggcctaccgaggcgaaaggggctggcgaggtggggtgacatctaagtatcaatagtaggaaacggaanactaaaagttaaatacctacgctaaacggaccgttaccgggtaaggaacggggtaccctacttaccaaccctatacctacccgaagaacgaaccaacctacccgaaaagaaccctaactacttttacacctagaactaaactacgaaacccgtacctaggaacgtaccgttaggaacgggtaacctacgggtacttaccggtactttaacgtttagtcggttaggacggtaagggtaacggggacgtacgtacggtactaccggaacgacgg

SEQ ID NO: 323411 - DNA, 658 bp, Homo sapiens
  misc_feature: GZ8MTXP02JL0LC.51.6.A06.1.454.CMB.2.raw
  modified_base (215)..(215): a, c, t, g, unknown or other
  misc_feature (215)..(215): n is a, c, g, or t
  modified_base (360)..(360): a, c, t, g, unknown or other
  misc_feature (360)..(360): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatcacctgctcgtgganatgctattcgacccaaaccctattattcttagttcggtaccaggcaagaacgccgaggacccacggccccttgtcgttacgtgatatataaagacacgtgagacgtctacgaggactccgtgagtcgtattcgtctcggcctacncctagacggacaagtggtacactagttacgacctagtcgtagtggacgtacccgaggacgaaggaaacgacggaacgggtctacgggtaactttaacgtttccgttaggttactaaactttccgttaacgaacggtaacgtaacttacgtacggttaccgttaagtttaacgtgtttaccgtttacggaaccggtttacgggaccttaagggtacctaccggtaccgttacgggacctacgaaccccggaacgtaccccaacccttacgtaccgtacctaccgttaccgttcccccgg

SEQ ID NO: 323412 - DNA, 731 bp, Homo sapiens
  misc_feature: GZ8MTXP02IK5AL.51.6.A06.1.454.CMB.2.raw
  modified_base (258)..(258): a, c, t, g, unknown or other
  misc_feature (258)..(258): n is a, c, g, or t
  modified_base (303)..(303): a, c, t, g, unknown or other
  misc_feature (303)..(303): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgcagtcgtgggggagcgtgtccagcctgggacgtcctgacgtactctctgtgacgcctntggattcagcttcagtacgtagttggtttcgcgtcgtgggtcccnccgaggcctcgaggcaagggacctggcgaggtcggggtgcagttctaagtctacgaattagtagaaaagggaacacgtaaaattaaaactacctacgacctaaaggaacctttcccgggaggaaaccgggacccgtaacgttaccaacctaacgttccctaaccgaagaaacggaaacctaaaccgtaaccccaaaagaaacccttaaaccttaaccttttttaaccacgtttacgaaacctaaaacgtccgtaaaaaccgttaccccgaaggtaacgtaccgttaaacgggaaccgtaccgggtaaccgtacgttacggtttaccgtttaacgtttaacgttacgggttacggtaacggggtaaaagtagggggaaaacccgttaaggtaacccggttacgttaacccggtaaaacgaaccccgggg

SEQ ID NO: 323413 - DNA, 539 bp, Homo sapiens
  misc_feature: GZ8MTXP02FQ4HY.51.6.A06.1.454.CMB.2.raw
  modified_base (189)..(189): a, c, t, g, unknown or other
  misc_feature (189)..(189): n is a, c, g, or t
  modified_base (257)..(257): a, c, t, g, unknown or other
  misc_feature (257)..(257): n is a, c, g, or t
  modified_base (297)..(297): a, c, t, g, unknown or other
  misc_feature (297)..(297): n is a, c, g, or t
  modified_base (359)..(359): a, c, t, g, unknown or other
  misc_feature (359)..(359): n is a, c, g, or t
  modified_base (453)..(453): a, c, t, g, unknown or other
  misc_feature (453)..(453): n is a, c, g, or t
  modified_base (476)..(476): a, c, t, g, unknown or other
  misc_feature (476)..(476): n is a, c, g, or t
  modified_base (490)..(490): a, c, t, g, unknown or other
  misc_feature (490)..(490): n is a, c, g, or t
  modified_base (523)..(523): a, c, t, g, unknown or other
  misc_feature (523)..(523): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcagtcgtgggggagcgtggtccagccgtgggagtccctgagactctcctgtgaagcctntggattcagcttcagtacgtatggttgcgcgtgggtcccncgaggcctccgaggcaagggactgcaggtgggtggcagtctatatcaatataggaaaggaancgaaataaactactacgcaagtacctcgtagaaacggccgtaattccgacctatcctaccagacgaacaaactaccaaagaacaactactttanctagacaaatgaaccacctaganactgacgacgacgntcgtacttattacgtagtcgagtaaggacgganacgtcgactcacgacg

SEQ ID NO: 323414 - DNA, 779 bp, Homo sapiens
  misc_feature: GZ8MTXP02I58WN.51.6.A06.1.454.CMB.2.raw
  modified_base (256)..(256): a, c, t, g, unknown or other
  misc_feature (256)..(256): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctcctatgtgctgacacagcccaccgtcggtgtccgtcgtccccaggacagacggccaggactcacctgctcgtgganatgctattcgacccaaacccacttacttctttaagttcggtaccagcaagaacgccgacggccacggccccttgttacgttgttagattataaataaaacgaccacgttgaacggtacggtccctttacggacgggtaccgttcccgtggtaacgcgttaactttccgtacgttcgggacccttacccgtacccgttacggaacggggaaactaacgttcgggtaacctaactaacgtttaccggaccctaacgtttaccgaaggggttacggtaaccgggttaaccgaacgggggtaccgaaaacgggaaaacgggaccggggtaaacgggcccgtttaaagggttaaaccttttacgttttaccgttaaacgggtttaacctaaactttttaccgttaaaccgtaaacggttaaccttacgttaaacgttacggtttaacggggttaaaccgtttttattacgggtttaacccggttacgggttaaacccggttacgggggtaaacccgtttaaaccgggg

SEQ ID NO: 323415 - DNA, 711 bp, Homo sapiens
  misc_feature: GZ8MTXP02G8KRZ.51.6.A06.1.454.CMB.2.raw
  modified_base (155)..(155): a, c, t, g, unknown or other
  misc_feature (155)..(155): n is a, c, g, or t
  modified_base (302)..(302): a, c, t, g, unknown or other
  misc_feature (302)..(302): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttccncgttgctcttttaagaggtgtccagtgtcaggtgcagctggtgcaggtcgtgggggagcgtggtccagccgtggggaggtccctgagctcgtcctggtgagcctcgtggattcagtcttcgagtcgtatggtttgcgcgtgggtccncaggcctcgaggccaaagggctggactagggtgggtcgcagttctaacgtatcaattagaggaaaggaatcctaaaataaaactaccgtaaccgcaaacggacctacccgggtaggaaacggggtcccctaaattcccgaaacctacgttacccgtaccctaaggaaaccgtaacctaaaccgtaacccccaaaaggaaacctaaacccgttactttttaacgacctttacgggaaaccctaaaaggttacccgaaaacctaccccggttaaggaaccgttaacccgtttagggaaccggaccgtaaaccccggggttagttacgttaacgttaaagttacgttacgggtacggaccgggtaaggtacggggtaacgtaccgttacggtaccgtaaccgaacggtaccg

SEQ ID NO: 323416 - DNA, 628 bp, Homo sapiens
  misc_feature: GZ8MTXP02JF4P0.51.6.A06.1.454.CMB.2.raw
  modified_base (309)..(309): a, c, t, g, unknown or other
  misc_feature (309)..(309): n is a, c, g, or t
  modified_base (338)..(338): a, c, t, g, unknown or other
  misc_feature (338)..(338): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccgaggacagacggccaggatcacctgctctggagatgcattcgaccctaaccctagttacttctttaagttcggtaacccagacagaacgaccaagccacggcccctgtcgttgtagatataataanacactgagagcttacgagggctcctagancgtatctactcggcctccacctcgacggacaagtcggtcactacttacgaacctagtacgaggtacggacgttacccgaggacgaaggaaacgaaccggaggaccgttacggtaaccgtttatttaccgttagttacttaaagttccttacaacgtatacgtactagtaccggttattagtcgttacgttacggacgtacgggaccgtacggtacgaccggtacgtacgtaccgaaccgacccgaaccgacccaaccccgtacgttacgcctaaccgttcctttaccccg

SEQ ID NO: 323417 - DNA, 591 bp, Homo sapiens
  misc_feature: GZ8MTXP02GLZLM.51.6.A06.1.454.CMB.2.raw
  modified_base (474)..(474): a, c, t, g, unknown or other
  misc_feature (474)..(474): n is a, c, g, or t
  modified_base (490)..(490): a, c, t, g, unknown or other
  misc_feature (490)..(490): n is a, c, g, or t
  modified_base (572)..(572): a, c, t, g, unknown or other
  misc_feature (572)..(572): n is a, c, g, or t
  modified_base (578)..(578): a, c, t, g, unknown or other
  misc_feature (578)..(578): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttggctgagctgggttttcctcgttgcttcttttaagaggtgtccagtgtcaggtgcagctggtgcaggtcgtgggggaggcgtggtccaggccgtgggacgtccctgagtactctccgtgtagagcctcgtggattcagtcttcgagttcgtattggttgcgtcgtcggtcccgcgaggcctcgaggcgaagggtctggcgaggtgggtcgctagtactaacgtatccgtaataggtagaaagggaactctaaaataaactacgtacgaccgagtactccggtaggaacgggtccgtaactacgacccacttacgaccaagaccgaaacactaccgaaanaacctactacgtttanctagaccaaagtacgaacaccgtagacgtacgtagacgacgtacggcttcgttatacttagtacgtggacggaagagggtanacgtanacgtcaacgtacg

SEQ ID NO: 323418 - DNA, 665 bp, Homo sapiens
  misc_feature: GZ8MTXP02GR9GW.51.6.A06.1.454.CMB.2.raw
  modified_base (270)..(270): a, c, t, g, unknown or other
  misc_feature (270)..(270): n is a, c, g, or t
  modified_base (376)..(376): a, c, t, g, unknown or other
  misc_feature (376)..(376): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcaggtcgtggggggaggcggtggtccagccgtggggacgtccctgagactctcctgtgaacgcctcgtggnttcagcttcgagtacgtattgggttgcgcgttcggggtcccgccgtaggcctaccgacggacgaaaggggctggacgtagggtggggtcgactacttctaagttanctaagtaagaggaaaaggaagactaaaataaaactaccgtaacgacaagtaccgtaccggtaggaacgggtccctaataccaacctacgtaccgtaccgaaagaacgaaccaaactaaccccgaaaacgaaacctaaaccttacttttaactacgtacgaaacctaaagtaccgaaaccctaacccgtagagtaccgtaggaacgaaccgtacggtcttacgttacttaagtttacgtggttacgacggtaaagggagggaaactagttaccgaattaccacgaaccgg

SEQ ID NO: 323419 - DNA, 654 bp, Homo sapiens
  misc_feature: GZ8MTXP02H9O2R.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgaccaaccactattcttattggtaccagcagaagccagccaggccctgtgttgtgatatataaagacactgagaggccttcgagggatccctgagcgtattctcgtgctcccacctcgagggacaagtggtacactattcgacctatctaaggtggacgtcccgagggacgaaggaaacggacggaagggtctcggtaaactttagtttctcggttactaaactttctttacaacggtactaacttacgtaggttacggttaacctttaagttcggttaccgtttaccgggtaaaccggttacggggaaacccgttaaagggttacctaaccccgggttaccgtttacggtacccgtaaccgacccccggtaaaaccgggaccccctaaaaccccgtacgtacggtaccctaacctttacccgtttccccgg

SEQ ID NO: 323420 - DNA, 589 bp, Homo sapiens
  misc_feature: GZ8MTXP02HNQPR.51.6.A06.1.454.CMB.2.raw
  modified_base (155)..(155): a, c, t, g, unknown or other
  misc_feature (155)..(155): n is a, c, g, or t
  modified_base (298)..(298): a, c, t, g, unknown or other
  misc_feature (298)..(298): n is a, c, g, or t
  modified_base (336)..(336): a, c, t, g, unknown or other
  misc_feature (336)..(336): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
  modified_base (539)..(539): a, c, t, g, unknown or other
  misc_feature (539)..(539): n is a, c, g, or t
  modified_base (561)..(561): a, c, t, g, unknown or other
  misc_feature (561)..(561): n is a, c, g, or t
  modified_base (572)..(572): a, c, t, g, unknown or other
  misc_feature (572)..(572): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttccncgttgctcttttaagaggtgtccagtgtcaggtgcagctggtgcagtcgtgggggagcgtggtccagccgtgggacgtcctgagctctcctgtgaacgcctctggattcagcttcagtacgtatggtttgcgctggggtcccnccgagggcctccgaggcgaaggggactgcgaggtgggnggcagttctaatactcagtagtaggaaacggagacaaaagttaaaatactaaccggactaagaccgttacccgtagggaaacgggacccgtattaccacctacttaccacccgaagacgaaccaactaccccaaagaaccaactactttanccgtanacctaaatacgaaacaccctagaacgtacgtagaacggacacggtntacgtagtacttacgtgtacgngaaggaggganatacggactacacgacg

SEQ ID NO: 323421 - DNA, 687 bp, Homo sapiens
  misc_feature: GZ8MTXP02JPHQD.51.6.A06.1.454.CMB.2.raw
  modified_base (318)..(318): a, c, t, g, unknown or other
  misc_feature (318)..(318): n is a, c, g, or t
  modified_base (433)..(433): a, c, t, g, unknown or other
  misc_feature (433)..(433): n is a, c, g, or t
  modified_base (491)..(491): a, c, t, g, unknown or other
  misc_feature (491)..(491): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtgcaggtcgtgggggagcgtggtccagcctggggagtccctgagtactctccgtgtgaacgccctcgtggattcagtcttacgaggttacgtattgggtttgccggtcgttggggtccccnccgaggggtccctccggaacggcgaaaaggggtcctgggcgtaggtggggtggacctaagttcctaatactactatagtaggaaaggaactaccaaattaaaacgtcgtaccganaagacttccgggagaaccggggcctaattccaactatccaccagaacgaacctaaacnccccaaaaggtaacccaaacttaccgttttaacacctacggtaaactaaaaccttacgaaaaccccttacccgtagtaaacgtccgttaaaggggaaccgttaccgaacccggttacgttacgttacgtttaacgtttacgtcgtacggtaacggaaggtaacgggtacgttacgtacggactaccgtaacgtacg

SEQ ID NO: 323422 - DNA, 652 bp, Homo sapiens
  misc_feature: GZ8MTXP02IM0GJ.51.6.A06.1.454.CMB.2.raw
  modified_base (273)..(273): a, c, t, g, unknown or other
  misc_feature (273)..(273): n is a, c, g, or t
  modified_base (315)..(315): a, c, t, g, unknown or other
  misc_feature (315)..(315): n is a, c, g, or t
  modified_base (387)..(387): a, c, t, g, unknown or other
  misc_feature (387)..(387): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtcttgggttttcctcgttgcttcgttttaaggaggttgtccacgttgtcaggtgcagctggtgcaggtcgtgggggagtcgtggtccaggccgtgggacgtcctgacgccttctcctgtgaacgccgtcnggtattcagtcttcagtacgtattggttgcgtcgtgggtccnccgaggcctccgaggtcaaagggctggcgtaggtgggtgcattccgtaatacgtcaagttagagaaaggaanactaaaataaactactaacgctaacgtaccttaccgtagaagggacctataccgacctactccgtaccaaaggacgaaactaacacctaaaagacctaactaacttttacacctagaaaccaacgtagaaccctacccgtagaacgtaacgtagaacgtacgtaacgggtcttacggttacttaaagtttacgtttacggtacgtaacgggaaggtaacggggtaagtaaccgttaacggtaccgtaaccgaaacgtaaacccgg

SEQ ID NO: 323423 - DNA, 499 bp, Homo sapiens
  misc_feature: GZ8MTXP02FIMFT.51.6.A06.1.454.CMB.2.raw
  modified_base (292)..(292): a, c, t, g, unknown or other
  misc_feature (292)..(292): n is a, c, g, or t
  modified_base (400)..(400): a, c, t, g, unknown or other
  misc_feature (400)..(400): n is a, c, g, or t
  modified_base (433)..(433): a, c, t, g, unknown or other
  misc_feature (433)..(433): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaaganactgagaggccttcagggatccctgagcgattctctcggctccactcagggacaatggtcacattgaccatcagtggatccaggcagaagacgaggctgactatttcngtcaaatcttacagacagtcagtgtactatgtntcgaatcgggaccaaaggtcacgtctaggtcagacccaagcccaaacccactgtaccacgtcctcg

SEQ ID NO: 323424 - DNA, 658 bp, Homo sapiens
  misc_feature: GZ8MTXP02HOY2U.51.6.A06.1.454.CMB.2.raw
  modified_base (171)..(171): a, c, t, g, unknown or other
  misc_feature (171)..(171): n is a, c, g, or t
  modified_base (339)..(339): a, c, t, g, unknown or other
  misc_feature (339)..(339): n is a, c, g, or t
  modified_base (384)..(384): a, c, t, g, unknown or other
  misc_feature (384)..(384): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagnggtgtccagtgtcaggtgcagctggtgcagtcgtgggggagcgtggtccaggccgtggggacgtcctgacgctctccgtgtgaacgcctctggattcagtcttcaggttacgtagttggttgcgtcgtcgggtcccgcgtacggctccgaggcgaacggggctggcgnggtgggtgactattccgtaatagtacagttagtaggaaacggaanaccgtaaaataaactacgtaacgacaacggtaccgtacggtacggtaacgggtaccctacgttacccactacttaccgtaccgaagtaaccgaactaacgtaaccccaaagtaaacctacttaactttactactacgaaacctaaactacgaaacccgtaccgtaggtaacgttaccgtagggaaccgtacctacgggtcttacggtaccttatttacgtggttacgacggaaggggtaggtaaacgtacggtacgtactaccgaacgtaccgg

SEQ ID NO: 323425 - DNA, 681 bp, Homo sapiens
  misc_feature: GZ8MTXP02IW0Q0.51.6.A06.1.454.CMB.2.raw
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
  modified_base (366)..(366): a, c, t, g, unknown or other
  misc_feature (366)..(366): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggaggtcccnganactctctgtgagtccctntgattcagtcttcagtacgtagtggttgcgtcgtgggtcccgccgaggcctcgaggcaagggctggcaggtgggtgctaagtctagtatcaatagaggaaaaggaacncgtaaaattaaaacgtacctaaccgacgaacgtaaaccgttcccggtagggaaaccgggtaccgtaacttaccgaacctactaccgtacccgaagtaacgaaccaaaactaccccgaaaaagtaaaccttaaaccttaaaccttttataccgttaacgaaacctaaaacgtaccggaaaacctacccgtaaggtaacgtacgtaacgggaacgttaccgacggttacgttacttacgtaaacgttttacgtacgggttaagacggaaaggggtaagggtacgtaaacgggttacaacgttaaccgaacgtaaccg

SEQ ID NO: 323426 - DNA, 527 bp, Homo sapiens
  misc_feature: GZ8MTXP02JUZ9K.51.6.A06.1.454.CMB.2.raw
  modified_base (336)..(336): a, c, t, g, unknown or other
  misc_feature (336)..(336): n is a, c, g, or t
  modified_base (428)..(428): a, c, t, g, unknown or other
  misc_feature (428)..(428): n is a, c, g, or t
  modified_base (441)..(441): a, c, t, g, unknown or other
  misc_feature (441)..(441): n is a, c, g, or t
  modified_base (477)..(477): a, c, t, g, unknown or other
  misc_feature (477)..(477): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccaggcctggggagtccctgagactctcctgtgagccctctggattcagcttcagtacgtatggtttgcgctgggtccgccaggctccaggcaagggctgcaggtgggtgcatcatancatatgaagaagcaaataaatctagacagactccgtagagggccattcacctagtctacgagagacaactacccaaagaacactactttaancctagaacaaatnaaaccacctagacgacttaggaacggtacaacggtntacgtactagtttacgttgtagcgaaggaggtagatccggaatcacgacg

SEQ ID NO: 323427 - DNA, 667 bp, Homo sapiens
  misc_feature: GZ8MTXP02FZ6WA.51.6.A06.1.454.CMB.2.raw
  modified_base (260)..(260): a, c, t, g, unknown or other
  misc_feature (260)..(260): n is a, c, g, or t
  modified_base (343)..(343): a, c, t, g, unknown or other
  misc_feature (343)..(343): n is a, c, g, or t
  modified_base (388)..(388): a, c, t, g, unknown or other
  misc_feature (388)..(388): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttcctccccctctcactctctgcacaggctctgacggcctcctatgtgctgacacacgcccaccgtggtcgtccgtcgtccccaggacaggaccgccaggactcacctgctcgtgganatcgatactcgacccaacctacttattcttagttacgacagcagaacgccgacggccacggtccctagtgtgttagatataanaacactacgtgagacgtccttagacggtactccgtgacgccgttnttaccgtccgtacggtcctacccgtacctacggaaacggactaagtccgtacacgttaactcggaaaccctgtaccgaaggttcggtaaccgacgacggagaaacggtaacgagggaccgtagtaacttacgtttaactttcgtaacgtacttaacgtttactaccgtaaaagtaccggttacctaagttaaccgggtttgttaaaaccgtttaggtttaccgtttaacccgggttaaggttaaaccggttaccggggttaaaacgtttaaacccgggg

SEQ ID NO: 323428 - DNA, 613 bp, Homo sapiens
  misc_feature: GZ8MTXP02FQ3SN.51.6.A06.1.454.CMB.2.raw
  modified_base (260)..(260): a, c, t, g, unknown or other
  misc_feature (260)..(260): n is a, c, g, or t
  modified_base (401)..(401): a, c, t, g, unknown or other
  misc_feature (401)..(401): n is a, c, g, or t
tcagcgatcgtatacacgaccggtgctcgatttagatctactgacagggcacgaccggtgctcgatttagatctactgacagggggctgtgggtccaggaggcagaactctgggtgtctcaccatggcctggactccctctacttctccccctctcactctctgcacaggctctgacggccttcctatgtgctgacacacgccacccgtggtcgtcccgtgtccccaggacagacggccaggactcacctgctcgtgganatcgcattcgacccaaaccctacttacttcttacttcggtaccagcaaggaacgccgaggccgacggccccttgttgtttgttagaattataaataaacgactacgtagagcgtcttacgagggtctccgtagacgtcgtntttcgtcgtgtcctaccaccgtcgaagggaactaacgtcggactactacgttagaacccagtacctaaggttcggacgtaccgaggtaccgaagaacgacgtagacgttactacgttacgtttctgtaacctattcgttacagtactacgtactaggttacgttaacgttgtacgtttaccgttaacggtacgtcgggtaaccgttaaccgg

SEQ ID NO: 323429 - DNA, 672 bp, Homo sapiens
  misc_feature: GZ8MTXP02HEE21.51.6.A06.1.454.CMB.2.raw
  modified_base (190)..(190): a, c, t, g, unknown or other
  misc_feature (190)..(190): n is a, c, g, or t
  modified_base (310)..(310): a, c, t, g, unknown or other
  misc_feature (310)..(310): n is a, c, g, or t
  modified_base (390)..(390): a, c, t, g, unknown or other
  misc_feature (390)..(390): n is a, c, g, or t
  modified_base (530)..(530): a, c, t, g, unknown or other
  misc_feature (530)..(530): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtncagctggtgcaggtcgtgggggagcgtggtccagccgtgggagtccctgacgtacctctctgtgaacgcctcgtggattcgagtcttcaggtacgtagttggtttgcgtcgtgggtcccncgaggcctccgaggcgaacgggctggcgtaggttggggtcgacctagtacttaatactctaaagtagtaggaaaggtaanactaaaagttaaaactaccgtaacgacctaagaccgttcccggtaaagggaacggtcccgtaacttccgaacctagtaccgtaccaaggaaccaacaaaaccctcccgaaaagaacctaaacttacctttactaccgtanaaactaaaacgtacgaaacctacccgtaggtaaacgtaccgttagaaccgggtaacacggggacctttacgttaactaggtttaacgtttggtaccgacgggtaaggtaacgggaagtacggtacgactaccgaactaacgg

SEQ ID NO: 323430 - DNA, 623 bp, Homo sapiens
  misc_feature: GZ8MTXP02JL001.51.6.A06.1.454.CMB.2.raw
  modified_base (232)..(232): a, c, t, g, unknown or other
  misc_feature (232)..(232): n is a, c, g, or t
tcagcgatcgtatacacgaccggtgctcgatttagatctactgacagggggctgtgggtccaggaggcagaactctgggtgtctcaccatggcctggatccctctacttcctccccctcctcactctctgcacaggctctgacggcctcctatgtgctgacacacgcccacccgtcggtcgtccgtcgtccccgaggacaggaccggccaggactccacctgcctcgtgganatgctattcgacccaaccctattattcttagttcggtaccagcaagacgccgacggccgacggccctgtcgttgtagatataataaacgacacgtagacgacgtccttagacggtactccgagacgcgtattccgtcgtcgcctccacctaggaacgacgtacgtcgacgactcgtacgacctatacgacgtacggacgtaccggaggacgaaaggaacggacgtacggtctacgttactttactttcgtacgtaacttaacgttcttacaacgaactacgtacgtagttacgttattacgttcgtacgtttaacggacgtacgggaccgtacgtccgtaccgtacgtacgacaaccgaccgaacgacccgacctacgtccgacttacccg

SEQ ID NO: 323431 - DNA, 651 bp, Homo sapiens
  misc_feature: GZ8MTXP02I7998.51.6.A06.1.454.CMB.2.raw
  modified_base (156)..(156): a, c, t, g, unknown or other
  misc_feature (156)..(156): n is a, c, g, or t
  modified_base (310)..(310): a, c, t, g, unknown or other
  misc_feature (310)..(310): n is a, c, g, or t
  modified_base (355)..(355): a, c, t, g, unknown or other
  misc_feature (355)..(355): n is a, c, g, or t
  modified_base (519)..(519): a, c, t, g, unknown or other
  misc_feature (519)..(519): n is a, c, g, or t
  modified_base (525)..(525): a, c, t, g, unknown or other
  misc_feature (525)..(525): n is a, c, g, or t
  modified_base (580)..(580): a, c, t, g, unknown or other
  misc_feature (580)..(580): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttccncgttgctcttttaagaggtgtccagtgtcaggtgcagctggtgcaggtcgtgggggagcgtggtccagccgtggggacgtccctgacgctctctgtgacgcctacgtggatcagtcttacgaggttacgtagttggttgccgtcgtgggtcccncgaggtcctaccgaggtcgaagggtctggcgtaggttggggtacnctaagttcctatactcaagtaagtaggaaaaggtaacacgtaaattaaaactccgtacgactaacggtaccgttccgggtaaggaaaccgggtccctaattacccgaccagttaccgacccgaagacaaccaaaccgtcccgaaaagacctacctaacctttanacgtanaaacctaaacgtacgaaccctacgtagacgttacgtaggaccgtaacgtaccgtnttacgtttaattagttacgtacggaggaacgggaaggtaggtaactacgtacgaacgtaccgaacgtaacg

SEQ ID NO: 323432 - DNA, 716 bp, Homo sapiens
  misc_feature: GZ8MTXP02IRY54.51.6.A06.1.454.CMB.2.raw
  modified_base (310)..(310): a, c, t, g, unknown or other
  misc_feature (310)..(310): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctctatgtgctgacacagccaccctggtgtccgtgtccccgaggacagacggccaggatcactgctctggagatgctattcgaccaaccattattcttagtggaccagcagaagccaggccacgccctgtgtgttgatataataagcactgagaggtctgaggactccngagcgtattctcgtcgcctaccacgtacgagggacaagttggtacaacgtacttacgaacctaagtctaggtacgtacgtcccgaaggaccttaaaggaaaggaccggtaggacctaaggtaaccgtttaaagttttccttaaggtacccttaaaagtttccgtttactaaacggaaaccttaatacccgttaaggggttacgtttaaaccctttaaaggttcgtttaccgttaaccggggaaaaccgttccggggaaaaccgtaaacggggttacccaaaccccgggtttttacccgtaaacggggtacccctaaaccggaacccccgtaaaaaggggtacccccccgtaaaaaacccccgtaccgttacccgttacccgtaaacccgtttcccgttaaccccgg

SEQ ID NO: 323433 - DNA, 757 bp, Homo sapiens
  misc_feature: GZ8MTXP02GUZ8K.51.6.A06.1.454.CMB.2.raw
  modified_base (175)..(175): a, c, t, g, unknown or other
  misc_feature (175)..(175): n is a, c, g, or t
  modified_base (189)..(189): a, c, t, g, unknown or other
  misc_feature (189)..(189): n is a, c, g, or t
  modified_base (331)..(331): a, c, t, g, unknown or other
  misc_feature (331)..(331): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtntccagtgtcaggtncagctggtgcaggtcgtgggggagcgtggtccaggccgtggggacgtccctaggacgtactctaccgtggtacgaacgtcccttcgtggtactttccgaggtcttacgagttacgtagtggtttgccgtacgtggggtcccncgaggcctccgaggcaagggctggacgagggttggggtcgactagttctatagtcaagtagtacggaaaggtaacgacctaaaagttaaaacgtacccgtaaacgggctaaacggtaccgtttacccggggaagggaaaccggggtccccttaagtttacccaaaccctagtacccctacccgaaggaaacccgaactaaaacccgtacccgtaaaaacgaacccttaaaccgtaccgtttttaacaccgttaacggaaaacctaaaacgttccgaaaacccgttacccggttaaggaacgttaaccgttagggaaaaccggaccgtaacgggttccttaaggttacctttaaatttaccggttaggaccggttaggggaaaggttagggacgtaaacgtccggttaacaacccgacgtaaaccgg

SEQ ID NO: 323434 - DNA, 530 bp, Homo sapiens
  misc_feature: GZ8MTXP02IA8B0.51.6.A06.1.454.CMB.2.raw
  modified_base (215)..(215): a, c, t, g, unknown or other
  misc_feature (215)..(215): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattgacccaaccatattcttattggtaccagcagaagccaggccaggcccctgtgttgtgatatataaagacactgagaggccttcgaggatccctgagcgtattctctcggcctccacctcgagggacaagtcggtcactattacgaccatcagtgagtaccagcagaagacgaggctgactnttcagtcaatcttnagtanatcgagtggttacttattagtcgttacggaacgttcgggaacctaggtacctaccggtctacggtcaacgcccaacggcccaacccgctacgtaccacttctaccccg

SEQ ID NO: 323435 - DNA, 561 bp, Homo sapiens
  misc_feature: GZ8MTXP02JCUCQ.51.6.A06.1.454.CMB.2.raw
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
  modified_base (457)..(457): a, c, t, g, unknown or other
  misc_feature (457)..(457): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggagtccctgagactctctgtgagcctctggattcagtcttcagtacgtagttggtttgcgtcgtgggtccnccgaggcctccgaggcgaagggctgcgaggtgggtgctatctatatcatagtagaaagganctaaataaactcgtaacgcaagacctcggtagaacgggtccattaccgacctatcctaccgaagaacgaacaactacccaaagaaccactactttanctagactaaaatcgaaaccaccgtagactacgtagaacggactacggcttacgtacttagttagtcgtgacggaaggtagggactactacgactcgaacgacgg

SEQ ID NO: 323436 - DNA, 547 bp, Homo sapiens
  misc_feature: GZ8MTXP02JPWJB.51.6.A06.1.454.CMB.2.raw
  modified_base (255)..(255): a, c, t, g, unknown or other
  misc_feature (255)..(255): n is a, c, g, or t
  modified_base (297)..(297): a, c, t, g, unknown or other
  misc_feature (297)..(297): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (362)..(362): a, c, t, g, unknown or other
  misc_feature (362)..(362): n is a, c, g, or t
  modified_base (389)..(389): a, c, t, g, unknown or other
  misc_feature (389)..(389): n is a, c, g, or t
  modified_base (448)..(448): a, c, t, g, unknown or other
  misc_feature (448)..(448): n is a, c, g, or t
  modified_base (469)..(469): a, c, t, g, unknown or other
  misc_feature (469)..(469): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggaggcgtggtccagcctgggagtccctgagctctcctgtgagcctntggattcagtcttcagtacgtatggtttgcgcgttgggtccncgaggctccaggcagggactgcaggtgggtgcatcatancatangaagagctaaataaatcacgnagactccgtagaacggcgatcacatcncagacgacactaccaaagaacactaactttacgactgactaaatcgaaaccacccgtanaacgtaacttagacggaaacncgggacttacggtcttaacgtttacgttacgtgtacggaaggacggggtaactaggttaccaagttaccgacgaacgg

SEQ ID NO: 323437 - DNA, 548 bp, Homo sapiens
  misc_feature: GZ8MTXP02JG130.51.6.A06.1.454.CMB.2.raw
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
  modified_base (437)..(437): a, c, t, g, unknown or other
  misc_feature (437)..(437): n is a, c, g, or t
tcagcgatcgtatacacgaccggtgctcgatttagatctactgacaggggtctggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccaggcctggggaggtccctgagactctctgtgagcctcnggattcagcttcagtacgtatggtttgcgtctgggtcccncgaggcctcgaggcaagggctgcgaggtgggngcatctatancatataggaaaggancaaataaactctacgnaagactcgtagacggccgatcacatcaccagacgacaacgtacccaaagaactacaactttanactagaacaaatcgaaacctacccgtgaatacgtagaacggtacacgggtcttacgtcttaaagttcgtaggtcgagggaagacggggaagtactaggactacgacgaacg

SEQ ID NO: 323438 - DNA, 726 bp, Homo sapiens
  misc_feature: GZ8MTXP02FMI5P.51.6.A06.1.454.CMB.2.raw
tcagcgatcgtatacacgaccggtgctcgatttagatctactgacagggcacgaccggtgctcgatttagatctactgacagggggctgtgggtccaggaggcagaactctgggtgtctcaccatggcctggatccctctacttctccccctctcactctctgcacaggctctgaggcctcctatgtgctgacacacgcccaccctcggtgtcccgtgtcccccgaggaccaggaccggccaggactcacctgctcgtggagatgcattcgacccaaacccctacttactttactttagttaggtacccagacgaagaacgccgaacggcccaaccgggtcccccgtgttcgtttggttactaagtaataaagttaaaacgaaccctacgtagaacggtacggtccttacggacgggtaccgtcccgtaggacgtacgtatttccgtcgttcgggtccctaccctacccgtacggaaacgggtacgtaaacgttcggtacctaacgtaacgttaccgaactactacgtaaggtacgggacgttacccgaagggaccggaaaaggaaaccgggaacggtaacggcgttaacggtaactttaacggttttctaacggttaccttacgttcttaacgaacggtactacgttaccgtaaggtttacgttaacgtttacgttacggttaccggtttaacggaccggttaacgggtaaccgttaaacccggg

SEQ ID NO: 323439 - DNA, 737 bp, Homo sapiens
  misc_feature: GZ8MTXP02FOBA1.51.6.A06.1.454.CMB.2.raw
  modified_base (172)..(172): a, c, t, g, unknown or other
  misc_feature (172)..(172): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (379)..(379): a, c, t, g, unknown or other
  misc_feature (379)..(379): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagnggtgtcagtgtcaggtgcagctggtgcaggtcgtgggggagcgtggtccagccgtgggacgtcctgagactctctgtacgacgcctgtggtatcagtcttcagttacgtagttggttgcgtcgtcgggtccncgnggtcctcgaggacgaagggctggcgagggttcgggtcgactagtctatatcaagttagaggaaaacgggaanacgtaaaaactaaaacgttaaccgaaaccgcgtaaacggtacccttacccgggaagggaaacggggtacccctattaacccaaccgttaacttaccctaccgaaaggtaacgaaaccctaaacccgtaacccaaaaagtaaaccctaacctttaacctttaactcggaaactaaaccaaaacgttccggaaaacccctacccgtaagggtaaccgtaccgttaagggggaaaccgtaaaccgtccgggtacctttaaggtttaaccttaaacgtttaggttaccggaacgtaaggggtaaagggttaaacgggaaagtttaaccggtaacgaacttaaccccgaagttaaaccccggg

SEQ ID NO: 323440 - DNA, 660 bp, Homo sapiens
  misc_feature: GZ8MTXP02G5ONU.51.6.A06.1.454.CMB.2.raw
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgacggcctcctatgtgctgacacacgccacccgtcggtcgtccgtcgtccccgaggacagacggccaggactcacctgctcgtagganatgctattccgaccctaaacctattatttccttagttacggtacagcaagacnccgaggccacggccctgtgttgtagaataataataaacgactacgtagaggtacggccttagacggactaccgtggacgtcgtattctcgtcggtcctacctacgtacgtacgggaactaagtcggtaccaactaagttacgaacctagtaccgaggttacggagtaccggaacgggacaaaggtaacgaccggaggtacgtacgtaacttacgtttactagttaacctaattacttaacgagtacctaagtcgtaaggttacggttactttaaggtcgttacggtacggaaacgttacgggaaccgtaggtaaccctcggtaccgttacgaccgaccgaaccgtaaccgaacccctacctacgtctactacccgtcttaccc

SEQ ID NO: 323441 - DNA, 776 bp, Homo sapiens
  misc_feature: GZ8MTXP02JN8ST.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtctgggttttcctcgttgctcttttaagaggtgtccagtgtcaggtgcagctgggtgcaggtcgtgggggggacgtcggtcggtaccgacggtcccggtagggggtaccgtcccgtaggacgtaccgttcctccgtggtacggaaccgtcccttcggtggtactcgacgttccttacgtacggttaacgtgttcggtttcggccgtaccgggtcggggtccccgccggtacggtcccgtaccggaaggaccggtaaacgggtcgtcggacggtaggggttcggggcgatacgttactatatactaagtagaggaaagaactataaagtaataccgtagagaacgtccgttccgggaaagacgggtacccttaactaccaaccttacgtacctaccggaaagaaccgttaaaccaccttaacccgaaaacgtacctaacctttaaccggttaatccgggaactaaaccaaagttaacccggaaccctaccggttagaaaccgttacggtaacgaaccgggtttacgacccgggttattaaacccgggtatttagttaaacgggtttacggccggaaaaggggtaagggaaggtttaacggaccttacgggtaaaccaacgggacctaaacccgg

SEQ ID NO: 323442 - DNA, 565 bp, Homo sapiens
  misc_feature: GZ8MTXP02IU0CH.51.6.A06.1.454.CMB.2.raw
  modified_base (298)..(298): a, c, t, g, unknown or other
  misc_feature (298)..(298): n is a, c, g, or t
  modified_base (343)..(343): a, c, t, g, unknown or other
  misc_feature (343)..(343): n is a, c, g, or t
  modified_base (457)..(457): a, c, t, g, unknown or other
  misc_feature (457)..(457): n is a, c, g, or t
  modified_base (469)..(469): a, c, t, g, unknown or other
  misc_feature (469)..(469): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggagtccctgagactctcctgtagaacgcctcgtggattcgagcttacagtacgtatggttgcgcgtggtccncgtaggctccgaggcaagggactgcaggtgggtgcagtctaatancatacgtagaaacggaagacctaaattaaaactaccgtaacgcaaaggacctccgtaggaacgggccattacacatctaccagacacaaatcccaaagaaactacaagttttanactgaacaaatnaaacctcctaagagtactaggacgaacgtaccggatttcgtactagttacgtcgtagacggaaggacggtaacgtacgtacgtaactacgaacacg

SEQ ID NO: 323443 - DNA, 628 bp, Homo sapiens
  misc_feature: GZ8MTXP02HD5C1.51.6.A06.1.454.CMB.2.raw
  modified_base (309)..(309): a, c, t, g, unknown or other
  misc_feature (309)..(309): n is a, c, g, or t
  modified_base (346)..(346): a, c, t, g, unknown or other
  misc_feature (346)..(346): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggagcgtggtccagccgtgggagtccctgacgactctcctgtgaagcctctggattcacgtcttcgagtacgtagttggttcggcgtcgtcgggtacccnccgaggcctccgaggacgaagggctgcgtaggtgggngctagtctaagtatcaatagtaggaaaggaagacaaagttaaataccgtagacgacgacgtaccggagacggggacctacttaccgacctactacctaccgagaacgtaacaaactacccaaaacgaactaaccttacctttaactacttacgaactaaacgttacgaaacccgtacccgaagtaacgtaccgtacgggaacgtaaccgtacggtacttacgttacttaacgtttacgtacgtgaacggtaagacgggagacgtacgaacgtaccacgaccg

SEQ ID NO: 323444 - DNA, 715 bp, Homo sapiens
  misc_feature: GZ8MTXP02JXRM7.51.6.A06.1.454.CMB.2.raw
  modified_base (220)..(220): a, c, t, g, unknown or other
  misc_feature (220)..(220): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacacgcccacccgtggtcgtccgtcgtccccaggacagacggccaggatcacctgctcgtgganatgctattccgacccaaaccctattactttcttaagttcggtaaccagcaaggaacgccgacggaccgtacggccccttggttcgtttgtagtaattataaagtaaacgactacgttaggaacgtacggtacccttacggacggggtaccttcccgtagacggtccgttaacgttccgtcgttccgtaccctacccgtaccgtacggaacggggaactaacgttcgggtacctaacgtacgttacgaaccctaacgttcgaggtcggtaacggtccgaaggacgaaaggaaacgacgggtacgtacgtacggtactttagttcgtacgtactaacttcgttacacggtactacgtcgtaggttacgttactttagtcggttacgttaaccgggaacgtaccggggactacggtaccgaaccgttcgtaacggtccgaacgacccgtaaccggtaccctaacccgtagttccgtaccgtacctccgtttaaccccg

SEQ ID NO: 323445 - DNA, 604 bp, Homo sapiens
  misc_feature: GZ8MTXP02FNCZO.51.6.A06.1.454.CMB.2.raw
  modified_base (156)..(156): a, c, t, g, unknown or other
  misc_feature (156)..(156): n is a, c, g, or t
  modified_base (310)..(310): a, c, t, g, unknown or other
  misc_feature (310)..(310): n is a, c, g, or t
  modified_base (389)..(389): a, c, t, g, unknown or other
  misc_feature (389)..(389): n is a, c, g, or t
  modified_base (507)..(507): a, c, t, g, unknown or other
  misc_feature (507)..(507): n is a, c, g, or t
  modified_base (577)..(577): a, c, t, g, unknown or other
  misc_feature (577)..(577): n is a, c, g, or t
  modified_base (587)..(587): a, c, t, g, unknown or other
  misc_feature (587)..(587): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttccncgttgctcttttaagaggtgtccagtgtcaggtgcagctggtgcaggtcgtggggggagcgtggtccagccgtggggacgtcctgacgctctcctggtgaacgcctctggattcagtcttcgagttacgtagttggttgcgtcgtcgggtcccncgtaggcctcggaggacgaaggggtctcgggacgtagggttgggcgactattactatactacattaagacgaaaggaanactaaaataactacgtaacgcaacggaacctcggtaagacgggacctataccactagtaccaccgaagaacgaacaaacgtacccaaaataccaaaccttacgttatacgtaacgaanaaacgtacacctactaaggactaacgtcggaaacgtaccgaggtaccttagtacttagttagtcgtaagnggaagtaggnaccgtgacacgacgacg

SEQ ID NO: 323446 - DNA, 631 bp, Homo sapiens
  misc_feature: GZ8MTXP02HKFM8.51.6.A06.1.454.CMB.2.raw
  modified_base (172)..(172): a, c, t, g, unknown or other
  misc_feature (172)..(172): n is a, c, g, or t
  modified_base (310)..(310): a, c, t, g, unknown or other
  misc_feature (310)..(310): n is a, c, g, or t
  modified_base (510)..(510): a, c, t, g, unknown or other
  misc_feature (510)..(510): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagnggtgtccagtgtcaggtgcagctggtgcagtcgtgggggagcgtggtccagccgtgggaggtccctgagtctcgtcctgtgaacgccctgtggacttcagtcttacgagttacgtagtggttgcgtcgtggggtcccncgaggctacccgaggtcgaaaggggctggcgaggtgggtgcatcgtatatctagtagtaggaaaggaagactaaaagttaaaactccgtacggacaacgtaaaccttccgggaagaaacgggccctaattcccgaacattccaccgaaagaacgtaaaccaactaaccccgaaaagaacctaactaacttttacacgtanaaactaaaatacgaaaccctaccgagtaacgtaccttaaggaacggtactaacgggtctaggtacttaatttacgttcgtaggacggaaggacggggtaactacgtacgactaccgaagcg

SEQ ID NO: 323447 - DNA, 642 bp, Homo sapiens
  misc_feature: GZ8MTXP02HOV96.51.6.A06.1.454.CMB.2.raw
  modified_base (311)..(311): a, c, t, g, unknown or other
  misc_feature (311)..(311): n is a, c, g, or t
  modified_base (384)..(384): a, c, t, g, unknown or other
  misc_feature (384)..(384): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcagtcgtgggggagcgtggtccaggccgtgggacgtcctgacgctctcctgtgaacgcctgtggattcagtcttcaggttacgtagttggtttgcgtcgttcggggtccccncgaggtcctccgaggcaacggggctggcgagggttggggtgacctatctaatatacattagtaggaaaggaanactaaaattaaaactaccgtacgactaacggtaccgtaccgggtagaaacggggtcccgtaattccaacctactacctacccgaaagacaaccaaactacccgaaagtaaacctactaaacttttatactacgaactaaacgtacgaaaccctacccgtaggaaacgtacgttacggaacggtaccgaacggtcttacgttacttagttacgtcgtacggaggaaggtagggaacgtactacgactacgaacgaccgg

SEQ ID NO: 323448 - DNA, 611 bp, Homo sapiens
  misc_feature: GZ8MTXP02FFZX8.51.6.A06.1.454.CMB.2.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
  modified_base (302)..(302): a, c, t, g, unknown or other
  misc_feature (302)..(302): n is a, c, g, or t
  modified_base (372)..(372): a, c, t, g, unknown or other
  misc_feature (372)..(372): n is a, c, g, or t
  modified_base (459)..(459): a, c, t, g, unknown or other
  misc_feature (459)..(459): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggngcaggtcgtgggggaggcgtggtccagccgtggggacgtccctgacgactctcctgtganccctctggattcagcttcagtacgtatggtttgcgctgggtccncgaggcctcaggcaaggggactgacagggtgggtgacagttctaatactcagttagtagaaacgggaaanacaaaataaactacgtacgcaacgtaccgtacggtaggaacggtcctactaccactatccacgaagaacaaccaaacctaccgaaanaacctaactactttacactacgaaactaacgtacgaacctacgtagacgtaacgtaggaacggtacgtacggtcttacgttacttaacgttacgttcgacggaacggtaagggtaacggggtaacgtacgtaccgaacgtaccgacgtaacg

SEQ ID NO: 323449 - DNA, 671 bp, Homo sapiens
  misc_feature: GZ8MTXP02HT5KS.51.6.A06.1.454.CMB.2.raw
  modified_base (294)..(294): a, c, t, g, unknown or other
  misc_feature (294)..(294): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtcccgtgtccccaggacaggacggccaggatcacctgctctggagatgctattcgacccaaacccattatttcttattcggtaccagcagaacgccaggccaggccctgtgttgtgatatanaaagcatgagacggtccttagagggactccgtgacgcgtacttctcgtcggtcctcctaccgtacgaaggggtacctaaagtcgggtactaacctagtttccgaaacctagttacgagggtacgggtaacgtacccgaagggaccgaaaggaaacggacggacgggtactacggactttagtttcgtacgttactaaagtttccttacaagtaactacttacgtaaggtttacggtttaactttagttacggttacgttaaccggggtaacggttacggggtaaaccgtaacggttcccgaaccggttaccgtaccggtacgaacccgacccgaacggaccccaacccgtctacgtccctacgttccctttccccgg

SEQ ID NO: 323450 - DNA, 655 bp, Homo sapiens
  misc_feature: GZ8MTXP02F4K0X.51.6.A06.1.454.CMB.2.raw
  modified_base (190)..(190): a, c, t, g, unknown or other
  misc_feature (190)..(190): n is a, c, g, or t
  modified_base (351)..(351): a, c, t, g, unknown or other
  misc_feature (351)..(351): n is a, c, g, or t
  modified_base (522)..(522): a, c, t, g, unknown or other
  misc_feature (522)..(522): n is a, c, g, or t
  modified_base (533)..(533): a, c, t, g, unknown or other
  misc_feature (533)..(533): n is a, c, g, or t
  modified_base (592)..(592): a, c, t, g, unknown or other
  misc_feature (592)..(592): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtgcaggtcgtgggggagcgtggtccagccgtggggacgtccctgagacctctctgtgaacgccctcgtggattcagtcttcgaggtacgttagttggttgcgtcgtcgggtcccgcgaggtcctaccgaggcgaaagggctggcgagggtgggngactagtctaatatacaatagtaggaaaggaactacaaaacgttaaaataccgaacgacgtaaacgtaccgtaccgggtaagggaacggtaccctatttacccaaacctagtacccaccgaaagaaccaaaccaaacctaccccgaaaaagaccctaaacttaacctttanacccgttaaanaaacctaaacgtaccgaaacccgtacgtagaccgttaagtacggaacgaccgtacgttntacttacgttatacgtacggacggaaggaaggggaagtacgtaacgtcaacgtcgaacgtacg

SEQ ID NO: 323451 - DNA, 803 bp, Homo sapiens
  misc_feature: GZ8MTXP02IR4UY.51.6.A06.1.454.CMB.2.raw
  modified_base (331)..(331): a, c, t, g, unknown or other
  misc_feature (331)..(331): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtctgggtttttcctcgttgcttctttttaagaggttgtccagtgtcaggtgcagctggtgcaggtcgtgggggagcgtggtccaggccgtggggacggtccctgacgtaccttctccgtggtgaacgtccttcgtggtacttcgagtctttcgaggttacgtagttggttcgccgtcgtcgggtcccncgtacggtcctcgaggcgtaaacgggctgcgtagggtggggtcgtacagttctaatactctaaagtagtaaggaaaggaaactacgtaaaacttaaactaccgtacgaccgtaaggtaccgttcccgggtaagggaaacggggtccctaacttaccgaaacctacgttaacccgacccgaaaggaaacccgtaaacctaaaaccccttaacccgaaaaacgtaaaaccctttaaaccgtttaaactttttaaacccgtacttaaaccggaaaaccttaaaaaccgttaccggaaaaccccttacccggaaaggttaaacggttaacccgtttaagggaaaacccggtaccggtaccggggtttaccttaggttttaaaacctttagttttaacgggttacgtaagggtaacccgggaaaggggtaacggggtaaactacggtaaccggtaaccgttacaaaccgggtaaccg

SEQ ID NO: 323452 - DNA, 630 bp, Homo sapiens
  misc_feature: GZ8MTXP02GTVZU.51.6.A06.1.454.CMB.2.raw
  modified_base (575)..(575): a, c, t, g, unknown or other
  misc_feature (575)..(575): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcaggtcgtgggggagcgtggtccagccgtggggacgtccctgacgcctctcctgtacgacgctcgtggattcagtcttacgaggttacgtagttgggtttcgcgtccggttcggggtacccgccgacggcctaccggaggcgaaaggggtctcgggcgtagggtcgggtcgactagttactacttatactaagtagtaggaaacggaatacgtaaaataaactaccgtacgaccgtaacgaccgttacgggaaggtaacggtccctaacttaccgacctacttacgaccaagaacgaacaacctaccgaaaataccaacttactttacgactacaactaaacgactaacctacgagtacgtacgtaggacggtacngtacttgtactattcgtcgtaggagaaggtaggatacacggtacacgacgaaccg

SEQ ID NO: 323453 - DNA, 568 bp, Homo sapiens
  misc_feature: GZ8MTXP02JYAQS.51.6.A06.1.454.CMB.2.raw
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (363)..(363): a, c, t, g, unknown or other
  misc_feature (363)..(363): n is a, c, g, or t
  modified_base (414)..(414): a, c, t, g, unknown or other
  misc_feature (414)..(414): n is a, c, g, or t
  modified_base (454)..(454): a, c, t, g, unknown or other
  misc_feature (454)..(454): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgatcttttaagaggtgtccagtgtcaggtgcagctggtgcagtcgtgggggaggcgtggtccaggccgtggggacggtccctgacgactctcctgtgaagcctgtggattcagtctcagtacgtattggttgcgtcgtcgggtccncgaggtcnccgaggcaagggctgcgaggtgggtgctatctatatcatagagaaagaancaaataaactacgacgaccaaggtacctcggtagaacggcgtactacaccnctactaccaagacgaacactacccaaagaccactacttancctagaacaaacgtacgaacctaccgtagaacgtacgtgaacgaccgcggcttacggtacttattacgttcggtacgacgggtaagaggggactacggtacgactacgacgacg

SEQ ID NO: 323454 - DNA, 734 bp, Homo sapiens
  misc_feature: GZ8MTXP02IY09Z.51.6.A06.1.454.CMB.2.raw
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
  modified_base (431)..(431): a, c, t, g, unknown or other
  misc_feature (431)..(431): n is a, c, g, or t
  modified_base (478)..(478): a, c, t, g, unknown or other
  misc_feature (478)..(478): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagcccacccgtcggtgtccgtcgtccccaggacagacggccaggatcactnctctgganatgctattcgacccaacctacttatttacttagttacggtaccagacaagacgccgacggccacggccctgtcgtttgtagataataataaacgacacgtgaacggcgtaccttaggacgggtacttcccgaggacgtactacgttcttacgcccggtactacccgacctcggaacggtaactaacgttcggtacctaacgtagtacgaaccctntaccgtagggtacgggtaacgtaccgaaggacgaaaggaaaaccggnggtacggtaccgtaggtttaaaccgtttctttacgttacggttaaactacttaccgtttcaaactacgttactaacggtaacgtcggttttaaacttaacggttccgttaacggttaaccggggtaaactacgggggtaaccttaaaccgggttacccgtaaaccggttaccgtttaaccggaccgacccggaaacccgaacccggtaacccctaacccgacgttccggtaaccttaccgttcccgtttaaccccg

SEQ ID NO: 323455 - DNA, 555 bp, Homo sapiens
  misc_feature: GZ8MTXP02IXKTD.51.6.A06.1.454.CMB.2.raw
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
  modified_base (300)..(300): a, c, t, g, unknown or other
  misc_feature (300)..(300): n is a, c, g, or t
  modified_base (358)..(358): a, c, t, g, unknown or other
  misc_feature (358)..(358): n is a, c, g, or t
  modified_base (446)..(446): a, c, t, g, unknown or other
  misc_feature (446)..(446): n is a, c, g, or t
  modified_base (519)..(519): a, c, t, g, unknown or other
  misc_feature (519)..(519): n is a, c, g, or t
tcagcgatcgtatacacgaccggtgctcgatttagatctactgacaggggtctgggagacgagcccagcactggaagtcgccggtgtttccattcggtgatcatcactgaacacagaggacctcaccatggagtttgggctgagctgggttttcctcgttgctcttttaagaggtgtccagtgtcaggtgcagctggtgcagtcgtgggggagcgtggtccagccgtgggagtccctgagactctcctgtgagcctntggattcagtcttcagtacgtattggttncgtcgtcgggtccncgaggcctccgaggcaagggctgcaggtgggtgcagtctatatcatagtgaaaggacncaaataataccgtacgcaagactcgtagacggtcctagtccactataccaccagaacgtaacaactccgaaagaacctactactttanccgtagaacaaacgtcgaaacctacccgtagacgtacgtgaacgacgacggtactcgtattacttagttacgnggtacgaaggtacggaatacgtacgactacacgacg

SEQ ID NO: 323456 - DNA, 596 bp, Homo sapiens
  misc_feature: GZ8MTXP02I1FMR.51.6.A06.1.454.CMB.2.raw
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
tcagcgatcgtatacacgaccggtgctcgatttagatctactgacagggggtgggtccaggaggcagaactctgggtgtctcaccatggcctggatccctctacttctccccctctcactctctgcacaggctctgaggcctcctatgtgctgacacagccaccctggtgtccgtgtccccaggacagacggccaggatcacctgctctgganatgctattcgcccaaccnttattcttattcggtaccagcagaagccagccaggccctgtgttgtgatatataaagcactgagtacggccttacgaggactcccgtgacgtcgtattctcgtcggtcctaccacctcgaacggaacaagtcgggtacactattcgacctagtcaagtggacgtccgagacgaaggtaaagacggacggtctacggtaacttagtttctagttacctaaacttcgttacacgtactactacgtagtacggttactagttcgtacgttacggaacgtcggaacgtacggtacctaaccggttctacggttacaacgacccgaaccggaccctaaccccgacgttacgtacctctacccgtttcccg

SEQ ID NO: 323457 - DNA, 624 bp, Homo sapiens
  misc_feature: GZ8MTXP02F2DCH.51.6.A06.1.454.CMB.2.raw
  modified_base (172)..(172): a, c, t, g, unknown or other
  misc_feature (172)..(172): n is a, c, g, or t
  modified_base (263)..(263): a, c, t, g, unknown or other
  misc_feature (263)..(263): n is a, c, g, or t
  modified_base (304)..(304): a, c, t, g, unknown or other
  misc_feature (304)..(304): n is a, c, g, or t
  modified_base (499)..(499): a, c, t, g, unknown or other
  misc_feature (499)..(499): n is a, c, g, or t
tcagcgatcgtatacacgaccggtgctcgatttagatctactgacaggggtctggggagacgagcccagcactggaagtcgccggtgtttccattcggtgatcatcactgaacacagaggactcaccatggagtttgggctgagctgggttttcctcgttgctcttttaagnggtgtccagtgtcaggtgcagctggtgcaggtcgtgggggaggcgtggtccagccgtggggacggtccctggagactctcctgtgagcctntggattcagcttcagtacgtatggttgcgtcgtgggtcccnccgaggcctccgaggcaagggactggcaggtgggtgctatctatatcaatagtaggaaaggaacgcaaaattaaaactacgtaacgacaaggtacctaccggtagggaaacggggtaccctattaccgaacctattacccgacccgaagaacgtaaccaaaactacccccaaaaagaaccctaaactacttttanaccttaagaactaaaactcggaaacctacccgtagaacgtacgttggaaacgactacggtacttcgtacttaatttacgtcgagtacggaaggtacggggaatacgtacgaactccgaacgtacg

SEQ ID NO: 323458 - DNA, 649 bp, Homo sapiens
  misc_feature: GZ8MTXP02JWFSO.51.6.A06.1.454.CMB.2.raw
  modified_base (155)..(155): a, c, t, g, unknown or other
  misc_feature (155)..(155): n is a, c, g, or t
  modified_base (170)..(170): a, c, t, g, unknown or other
  misc_feature (170)..(170): n is a, c, g, or t
  modified_base (188)..(188): a, c, t, g, unknown or other
  misc_feature (188)..(188): n is a, c, g, or t
  modified_base (319)..(319): a, c, t, g, unknown or other
  misc_feature (319)..(319): n is a, c, g, or t
  modified_base (405)..(405): a, c, t, g, unknown or other
  misc_feature (405)..(405): n is a, c, g, or t
  modified_base (631)..(631): a, c, t, g, unknown or other
  misc_feature (631)..(631): n is a, c, g, or t
  modified_base (647)..(647): a, c, t, g, unknown or other
  misc_feature (647)..(647): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttccncgttgctctttaagnggtgtccagtgtcaggtncagctggtgcaggtcgtgggggagcgtcggtccaggccgtaggggacgtccctgacgtctctcctggtgaacgcctcgtggtattcgagtcttcgagttacgtagttcggtttgccgtcgtcggggtcccncgaggcctccgaggtacgaaggggcctggcgtaggttggggtcgactattaccgtaatactactataaggtaggaaaacgggtaanactaaaagttaaacgtaccgtacgacgtaacgacccgttacgggtaaggaaaccgggtacccgtacgttaccgaaccctactccgtaccaaggaacaaactaaacctacccgaaacgaacctactacttactactacgaaccaaacgtacgaaacctaccgtagacgtaccgtagaacggacgtacggtctcgtacttagttacgtagtcggtagaaggagggtanacgtactacgcgaacncg

SEQ ID NO: 323459 - DNA, 587 bp, Homo sapiens
  misc_feature: GZ8MTXP02FGP28.51.6.A06.1.454.CMB.2.raw
  modified_base (238)..(238): a, c, t, g, unknown or other
  misc_feature (238)..(238): n is a, c, g, or t
  modified_base (261)..(261): a, c, t, g, unknown or other
  misc_feature (261)..(261): n is a, c, g, or t
  modified_base (305)..(305): a, c, t, g, unknown or other
  misc_feature (305)..(305): n is a, c, g, or t
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
  modified_base (489)..(489): a, c, t, g, unknown or other
  misc_feature (489)..(489): n is a, c, g, or t
  modified_base (556)..(556): a, c, t, g, unknown or other
  misc_feature (556)..(556): n is a, c, g, or t
  modified_base (571)..(571): a, c, t, g, unknown or other
  misc_feature (571)..(571): n is a, c, g, or t
  modified_base (580)..(580): a, c, t, g, unknown or other
  misc_feature (580)..(580): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccaggccgtgggacgtcccngacgactctcctgtgacgccctntggattccagcttcagtacgtattggttcgcgtcgtcgggtccnccgaggcctcgaggaccaggggtacngcagggtggtgctntctatagtcatatagaaaggactacaaaactaaactaccgtacgacaacgtacgtcccggtaaagaaacggggtccctagttacccaccgtattccaaccgaggaaacacaaacctacccaaaagtaccaaactactttaacgntacgactaaactacgaaccacccgtagacgtacgtagacggaacaggtcctagtacttattagtcgngtacgaaggaggtancgtacgtanacacacg

SEQ ID NO: 323460 - DNA, 702 bp, Homo sapiens
  misc_feature: GZ8MTXP02GSOCB.51.6.A06.1.454.CMB.2.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgctattcgacccaacccacttattcttattggtaccagcagaagccaggccaggccctgtgttgtgatataataaagacacgtgagaggtccttacgagggactcccgtagagcgtattctcgtccggcctccacgtcgagggacaagtcggtacactattacgacctatcgaggtagggacgttacccgaggaccgaaggaaacggacggacgggtacctaggtaaccttatttacgtaggttaacctaaattcctttacggaagtacctaaattccgtaaggtttacgggttaacctttaaagttcggttaccgtttaaccggggtaaacgttaccgggggtaaacccgttaaacgggggtttcccaaacccgggtttaccgttaccgggaacccgtacccggtaaaccccgtaaaccgggtaacccccccgaaaccccgtaccttacggtaaccccgtcccgtttaccgttttaacccccg

SEQ ID NO: 323461 - DNA, 589 bp, Homo sapiens
  misc_feature: GZ8MTXP02JAIFT.51.6.A06.1.454.CMB.2.raw
  modified_base (305)..(305): a, c, t, g, unknown or other
  misc_feature (305)..(305): n is a, c, g, or t
  modified_base (396)..(396): a, c, t, g, unknown or other
  misc_feature (396)..(396): n is a, c, g, or t
  modified_base (437)..(437): a, c, t, g, unknown or other
  misc_feature (437)..(437): n is a, c, g, or t
  modified_base (507)..(507): a, c, t, g, unknown or other
  misc_feature (507)..(507): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtgggacgtccctgagactctcctgtagagcctctggattcagtcttgagtacgtatgggtttcgcgcgttgggtcccnccgaggcctccaggccgaaggggacctggcgagggtgggtgcctatctatatcaatacgtaggaaagagactaaaagttaaactactacgntaggacctacccggtaggaaacgggcctaattaccgaaacncgttacaccgaggaacacaaaccacctaaacgaaactactaacttactcctagaactaaacgtcaaaccncccgtagaactacgtagacggtaacctcggtacttgtacttattcttaggcgaggaagagggatacgacgaatcgaacacgg

SEQ ID NO: 323462 - DNA, 665 bp, Homo sapiens
  misc_feature: GZ8MTXP02GD6II.51.6.A06.1.454.CMB.2.raw
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcaggtcgtgggggaggcgtggtccagccgtgggagtccctgagctctcctgtgagcctgtggatccagcttcgagttacgtagttcggttgcgtcgtggggtccaccgaggtcctccgaaggcgaaacggggactggaccgtagggtcgggtcggactagttctagtactactaagtagtacggaaaaggaacgactaaaataaactaacgacgactaacgtacgtcccggtaagaaaccggggaccctattaccacccgtatcccgaccaagaaccgaacaacctacccgaaaacgaacctaactaacttttacacttacgaaacttaaacgtacaacccgtaacccgtaggtaaacgtacgttaacgggaacgaaaccgtacggttacctacggttaccttaaagtttctacggtcgaagggtaaaggtacgggagttaaacgtcgtaacctacggaacgtaacg

SEQ ID NO: 323463 - DNA, 552 bp, Homo sapiens
  misc_feature: GZ8MTXP02F9YBH.51.6.A06.1.454.CMB.2.raw
  modified_base (255)..(255): a, c, t, g, unknown or other
  misc_feature (255)..(255): n is a, c, g, or t
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
  modified_base (441)..(441): a, c, t, g, unknown or other
  misc_feature (441)..(441): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtcgtgggggagcgtggtccagccgtgggacgtccctgagctctctgtgagcctntggattcagtcttcagttacgtatggtttgccgtcgtgggtcccncgaggcctccgaggcaagggctgcgaggtgggtgcagtctatatnatataggaaagagactaaataaactactacgcaagacgtccgtagaacggcctatccacatccacagaacgacaactaccaaagaacactacttanctagaacaaatcgaacctaccgtagacgtactaggacgacgacggtacttcgtacttagtttacgttcggacgtaggaaggtacgggatacgtaccgactaccgacgtacg

SEQ ID NO: 323464 - DNA, 684 bp, Homo sapiens
  misc_feature: GZ8MTXP02GIVY3.51.6.A06.1.454.CMB.2.raw
tcagcgatcgtatacacgaccggtgctcgatttagatctactgacagggggctgtgggtccaggaggcagaactctgggtgtctcaccatggcctggatccctctacttctcccccctcctcactctctgcacaggctctgaggcctcctatgtgctgacacagccaccctcggtgtccgtgtccccaggacagacggccaggatcacctgctcgtggagatgcattcgacccaaacccacttattcttattggtaacccagcagaagccaggccacggcccctgtgttgtagatataataaagactatgagacggtccttagaagatactcctaggacgcgtactttcctcgtacggtccctacccaccgtacgacggggactaaacgtcggtacaacgtaagttcgaaaccctataccgaaggttggaacgtaccgaaggacgaaggaaacgacggagtccgtagtaacgttatttccggtattactaattcttaccaagtactagttacgtaaggttacgttaacgtttagttacggttaccgttacggggtaaaccgttcggggtaaacccgttaaacggttaccccgtaacccggttacccgttaacggaaccgtaaacccggaccccggtaaaacccgggaacccccctaaacccccgtacggttaccgttaaccccg

SEQ ID NO: 323465 - DNA, 672 bp, Homo sapiens
  misc_feature: GZ8MTXP02JM4EO.51.6.A06.1.454.CMB.2.raw
  modified_base (155)..(155): a, c, t, g, unknown or other
  misc_feature (155)..(155): n is a, c, g, or t
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (350)..(350): a, c, t, g, unknown or other
  misc_feature (350)..(350): n is a, c, g, or t
  modified_base (390)..(390): a, c, t, g, unknown or other
  misc_feature (390)..(390): n is a, c, g, or t
  modified_base (483)..(483): a, c, t, g, unknown or other
  misc_feature (483)..(483): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctgggttttccncgttgctcttttaagaggtgtccagtgtcaggtgcagctggtgcagtcgtgggggagcgtggtccaggccgtggggagtccctgacgactctcctgcgagcctntggattcagtcttnagtacgtagtggttgcgtcgtgggtcccgcgtaggcctccgaggcgaaagggctgcgaggtggtcgcagtctaagtntcaatagtagaaaggagtactaaataaactaaccaccganaacggtaccgttccggtaagggaacggggacccctaattacccgaacctacttacccgaccgaaggaaactacctaaacctaccccggaaaanaaccctaacttacttttaacgacctacggtaaactaaaacgtaccaaacccgtacccgtaggtaaccgtacgttacgggaaaccggtcggaaaccgggtcctttaggtaccttttaaacgttacgtttggtaccggaacggtaagggaaggtaaaacgtccgttaccggaattacccgaaacccgtacg

SEQ ID NO: 323466 - DNA, 709 bp, Homo sapiens
  misc_feature: GZ8MTXP02GPKO2.51.6.A06.1.454.CMB.2.raw
  modified_base (208)..(208): a, c, t, g, unknown or other
  misc_feature (208)..(208): n is a, c, g, or t
  modified_base (266)..(266): a, c, t, g, unknown or other
  misc_feature (266)..(266): n is a, c, g, or t
  modified_base (275)..(275): a, c, t, g, unknown or other
  misc_feature (275)..(275): n is a, c, g, or t
  modified_base (317)..(317): a, c, t, g, unknown or other
  misc_feature (317)..(317): n is a, c, g, or t
  modified_base (399)..(399): a, c, t, g, unknown or other
  misc_feature (399)..(399): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagctggggttttcctcgttgcttcttttaagaggtgtccagtgtcaggtgcagctggtgcaggtcgngggggagcgtggtcagccgtgggaggtccctgagtacctctcctgtacgaacgccctntggattcgngtctcgaagtacgtagttggtttcgaccgtcgtcggggtccnccgaggtcctaccgaggcgaaggctggcgtagggtgggtacgctaatcgttaatcgtacgtaataggtaggaaacggtaaanaccgtaaaattaaacaccgttaacgagaaccgtaccgtaccgggtggaaaccggggtccctagttacccaacgtactaccgtaccgaacgacgtaaacaaacgaccccgaaaataaccaactttaacgttaatccgttagaaaccaaaacgttaccgtaaaaccctaccgtaagggtaacgttaccgtaaggaaacccgggtccgaccgggtttactaagggttaccctttaaagttagtttaccggaaggggtttaccgaaagggtaacggggtagtaacctaccgggtagttaccccaggtaaacccg

SEQ ID NO: 323467 - DNA, 688 bp, Homo sapiens
  misc_feature: GZ8MTXP02HQR6J.51.6.A06.1.454.CMB.2.raw
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (373)..(373): a, c, t, g, unknown or other
  misc_feature (373)..(373): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtgcaggtcgtggggggagcgtggtccagccgtggggacgtccctgagtacctctcctgngaagcctgnggattcagtcttcagttacgtattgggttcgcgtacggttcggggtccccgccgtagggtccctacccggaggaccgaaaacgggggtactggcgtaggggttggggnggtaccaatttcctaatacgttacaaagttagtaaggaaaagggaagtacctaaaagttaaaactaaccgtaaccgacgtaaacgaccgttaaccgggtagggaaacggtacccggtattacccaccacttacctacccgaaagtaacgaacctaaaccgtaaccccaaaagtaaaccctaacttaaccttttacacgtacaaactaacgtaacaaaccctaccctaggaacgtacgtcggaaacgacgtacggtactacggttattacttaagtcgttaggaggtaaggaggacggtatacggacacaacgacg

SEQ ID NO: 323468 - DNA, 624 bp, Homo sapiens
  misc_feature: GZ8MTXP02JCE5B.51.6.A06.1.454.CMB.2.raw
  modified_base (174)..(174): a, c, t, g, unknown or other
  misc_feature (174)..(174): n is a, c, g, or t
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
  modified_base (277)..(277): a, c, t, g, unknown or other
  misc_feature (277)..(277): n is a, c, g, or t
tcagcgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctggtntccgtgtccccaggacagacggccaggatcactgctctggagatgcattgccaaaccngtattcttatggtaccngcagagcagccaggtccctagtgtgtanatagtataaagacatgagacggtcttacgaggatccctagagcgtatccgtctcggctccacgtacgagggtaccaaagttcggacaaccgtattacggacctaattacgagtaggtacgtacgaggaccgagaaacgacgtaggcttagacttaatttcctagtctaaactcggtttacaacgtactatacgggtaatacgggttattaaagtttcgtacgtttaacggggaaacttcggggaaaccctaaagggttcccaaaaccgggtttccttaaacgggctaaaacccgacccgttaaaaccggggaacctaaaacccccgaatttaccggccttaaccccg

SEQ ID NO: 323469 - DNA, 695 bp, Homo sapiens
  misc_feature: GZ8MTXP02H21X7.51.6.A06.1.454.CMB.2.raw
  modified_base (212)..(212): a, c, t, g, unknown or other
  misc_feature (212)..(212): n is a, c, g, or t
  modified_base (323)..(323): a, c, t, g, unknown or other
  misc_feature (323)..(323): n is a, c, g, or t
tcagcgatcgtatacacgaccggtgctcgatttagatctactgacagggggtggtccaggaggcagaactctgggtgtctcaccatggcctggatcccctctacttctccccctctcactctctgcacaggctctgaggcctctatgtgctgacacagccacccgtggtgtccgtgtcccaggacagacggccagatcacctgctcgtgganatgctattgacccaacctattattcttattggaccagcagagcagcacgccctgtgtgtgatagtaataaagacactgaggaggcttcgaggtactccgtgagcgtatctntcgctccactcgaggacaagtcgacactattcgactatacgagtacggaaacgcccgaaggacgtaaggaaacggacggaacgggtacttacggtaacctttatttacggtacgttaccgtaaagtttacccgttaaacgtaacgtaaccgttagttaacggttaacggttacggtttaacgtttaacggtttaccggtttaaccggtttaaacgggtaaaccgggttacgggtaaaacccggttaacgggtaacccggttacccgggttaccggttaaccgggtaacccgtaacccggtaacccggtaaacccgaacccccgtaaacccgtaccgtaccgttacccgttacccgtttacccggtaccccgg

SEQ ID NO: 323470 - DNA, 721 bp, Homo sapiens
  misc_feature: GZ8MTXP02HL8UW.51.6.A06.1.454.CMB.2.raw
  modified_base (266)..(266): a, c, t, g, unknown or other
  misc_feature (266)..(266): n is a, c, g, or t
tcagcgatcgtatacacgaccggtgctcgatttagatctactgacagggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgcaggtcgtgggggagcgtggtccagccgtgggacggtccctgacgactctcctgtgaacgccctcnggattcagtccttacaggttacgtagttggtttgcgtcgttcggggtcccgccgtaggcctaccgaggaccgaaaggggctggcgtaggtggggtgctaagtctatagtcaagtaagtacggaaaagggaacacgtaaaattaaaaccgtaccgtaaacgactaaggtacccgttacccgggaaggggaaaccgggacccgttaaacttcccgaaacccgtaacttacctaacccgaaggaaacgtaaaacccaaaccgttaaccccaaaaagaaaccctaacctttaaacgtttaacctactacaaacgtaaaacgtaccgtaaaacccaaccgtacggacgtaacgttacgggaacggtacccgtaacgggtacttaggttacctttaaacgtttagttcggtacgaacgggaaggtacggggtaataacggtatacccgtaacaaccggacg

SEQ ID NO: 323471 - DNA, 648 bp, Homo sapiens
  misc_feature: GZ8MTXP02IOV4Q.51.6.A06.1.454.CMB.2.raw
  modified_base (173)..(173): a, c, t, g, unknown or other
  misc_feature (173)..(173): n is a, c, g, or t
  modified_base (338)..(338): a, c, t, g, unknown or other
  misc_feature (338)..(338): n is a, c, g, or t
  modified_base (393)..(393): a, c, t, g, unknown or other
  misc_feature (393)..(393): n is a, c, g, or t
  modified_base (483)..(483): a, c, t, g, unknown or other
  misc_feature (483)..(483): n is a, c, g, or t
  modified_base (502)..(502): a, c, t, g, unknown or other
  misc_feature (502)..(502): n is a, c, g, or t
tcagcgatcgtatacacgaccggtgctcgatttagatctactgacaggggtctgggagacgagcccagcactggaagtcgccggtgtttccattcggtgatcatcactgaacacagaggactcaccatggagtttgggctgagtctgggttttcctcgttgtcttttttaagnggtgtccagtgtcaggtgcagctggtgcgaggtcggtgggggagtcgttggtccagcccgtggggacggtccctggaacgtcttccgtccgtgtagaacgtccttcgtggtactttcgagtcttacgagttacgtagttggtttcgcgtcgtcgggtccccacgnggtccaccgagggtaccgaaaggggtctggacgtaggtcggggcgctatcgttanactcgataagtaggaagaacactaagtaactacgtaacggcaagtacgtacggtagaaacggtcacttcgactatcaacagtacactaanaccataactactattacgntacataagacacctacgtagaacgtacgtagaacgggtaccctagggtccctttagtaacgttttaagtacggtttcgacggggttacggttaaaggaagggggttacctagggttacccctaagaaccggactaacgggaacccc

SEQ ID NO: 323472 - DNA, 554 bp, Homo sapiens
  misc_feature: GZ8MTXP01DW6MB.4.39.D06.1.454.CMB.2.raw
  modified_base (323)..(323): a, c, t, g, unknown or other
  misc_feature (323)..(323): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctcctggtaccaacaacacccagacaaacgcccccaaatcataattatgagtcactaagcggccctnaggggtccctgatcgcttcctctgcctcaaggctggcaacacgcctccctgaccgtctctgggctccgaggctgaggatgaggctgattattattgctagctcatatgcgaggacgagttaataaatagttgtaagtaagtttacggtacgggacgggaaccgaaacgttacgttaccgttaccgtaacggtacgaacgacccgaacggaccgtccgttccccgtccccgg

SEQ ID NO: 323473 - DNA, 559 bp, Homo sapiens
  misc_feature: GZ8MTXP01DPROI.4.39.D06.1.454.CMB.2.raw
  modified_base (230)..(230): a, c, t, g, unknown or other
  misc_feature (230)..(230): n is a, c, g, or t
  modified_base (305)..(305): a, c, t, g, unknown or other
  misc_feature (305)..(305): n is a, c, g, or t
  modified_base (431)..(431): a, c, t, g, unknown or other
  misc_feature (431)..(431): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcttaataactatgtctctggaccaacaacaccaggcaaacgccccaaattcaataatttangagtcactaagcggccctcgagggtccctgatcgcttcctctgcctcaagctggcaacaccggccctccctgaccgtctcgtcgggctccgaggctggagatgaggtctgattattattgcagctnatatgcaggtactagttaacaagttgtagtaattaaggttcggggacggaaggggaaaccctaaacgttcggacccgttacgtaacgggtaccaacggccccaagggcccttccgccccccgttcggg

SEQ ID NO: 323474 - DNA, 518 bp, Homo sapiens
  misc_feature: GZ8MTXP01EHCXV.4.39.D06.1.454.CMB.2.raw
tcagagcactgtagcacgaccggtgctcgatttagtgacatctcgcagttctttggggggtcgtcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtcaccatctcctgcactggaaccagcagtgacgttggtcgttataactatgtctcctggaccaacaacacccaggcaaagcccccaaattcataatttatgaggtcactaagcggccctcagggggtccctgatcgcttcctctgcctccaaggctggcaacacgggccctccctgaccgtctctgggctccaggctgaggatgaggctgattattattgcagctcatatgcaggcagttacaatgtgaattagttcgggcgggagggaccaaacttgaccgttcctaaggtcaagcccaaggctcgcccctcgg

SEQ ID NO: 323475 - DNA, 518 bp, Homo sapiens
  misc_feature: GZ8MTXP01CKX2K.4.39.D06.1.454.CMB.2.raw
tcagagcactgtagcacgaccggtgctcgatttagtgacatctcgcagttctttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttataactatgtctcctggtaccaacaacaccaggcaaagcccccaaattcataatttatgagtcactaagcggccctcaggggtccctgatcgcttcctctgcctccaaggctggcaacacggcctcctgaccgtctctgggctccaggctgaggatgagctgattatattgcagctcatatgcgtaggctagttacaatgtgaatagttcgggcggagggaacctaaacgttcgccgttcgtaaggtcaacgcccaagggcctcgcccccgtcgg

SEQ ID NO: 323476 - DNA, 515 bp, Homo sapiens
  misc_feature: GZ8MTXP01D3ZZN.4.39.D06.1.454.CMB.2.raw
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (432)..(432): a, c, t, g, unknown or other
  misc_feature (432)..(432): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttaataactatgtctcctggtaccaacaacaccagacaaagccccaaatcataattatgagtcactaagcgccctgagggtccctgattgcttctctgcctcaaggctggcaacacggcctccctgaccgtctctggctccaggctgagatgagctgattatatgcagctanatngcagactagtanatgtataatagttcggaacggaacggaaacctaaacttcgaccgttacgtaaggtacaacgacccgaggcctccgccccgtcg

SEQ ID NO: 323477 - DNA, 529 bp, Homo sapiens
  misc_feature: GZ8MTXP01D2FKY.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctctggtaccaacaacaccaggcaaacgcccccaaattcaataattatgagtcactaagcggccctcaggggtccctgatcgcttcctctgcctccaagctggcaacacggccctccctgaccgtctctcgggctccaggctgagatgaggctgattattattgcagctcatatgcaggcagttacaatgtgaatagttcgggcggttaggggacctaaaacgttgacccgttcctaagggtcaacgacccaagggccttcgcccccgttcg

SEQ ID NO: 323478 - DNA, 541 bp, Homo sapiens
  misc_feature: GZ8MTXP01B5ZV0.4.39.D06.1.454.CMB.2.raw
  modified_base (296)..(296): a, c, t, g, unknown or other
  misc_feature (296)..(296): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgtaccaacaacaccagcaaagccccaaatcataattangagtcactaagcggccctcgaggggtccctgactcgcttcctctgcctcaaggctggcaaacgacggccctccctgacccgtctctgggctccgaggctggagatgaggctgattatattgcagctcatatgcaggctagttaacaatgtagtaataagttcgggacggacgggaaccaaaacgttcggaacccgttccgttaagggccaacggaccccaagggcctccggttcccccgttcggg

SEQ ID NO: 323479 - DNA, 503 bp, Homo sapiens
  misc_feature: GZ8MTXP01DJ1RX.4.39.D06.1.454.CMB.2.raw
  modified_base (372)..(372): a, c, t, g, unknown or other
  misc_feature (372)..(372): n is a, c, g, or t
tcagagcactgtagcacgaccggtgctcgatttagtgacatctcgcagttctttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcacatctcctgcactggaaccagcagtgacgttggtcgttataactatgtctcctggtaccaacaacacccaggcaaagcccccaaattcataatttatgaggtcactaagcgccctcaggggtccctgatcgcttcctctgcctccaaggctggcaacacggcctcccngaccgtctctgggctcaggctgaggatgagctgattatatgcagctcatatgcaggcagttacaatgtgaatagttcggcggagggaccaaattgaccgttctaaggtcaagcccaaggctcgcccctcgg

SEQ ID NO: 323480 - DNA, 513 bp, Homo sapiens
  misc_feature: GZ8MTXP01AKRGZ.4.39.D06.1.454.CMB.2.raw
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactatgtctcctggaccaacaacacccaggcaaagcccccaaattcataatttatgagtcactaagcggccctcagggggtccctgatcgcttcctctgcctccaaggctggcaacacggcctccctgaccgtctctgggctccaggctgaggatgaggctgattatattgcagctcatatgctaggctagttacaatgtgaatagttcgggcggagggaccaacgttcgaccgttctaaggtcaacgccaggctccgccccgtcgg

SEQ ID NO: 323481 - DNA, 650 bp, Homo sapiens
  misc_feature: GZ8MTXP01BE7N8.4.39.D06.1.454.CMB.2.raw
  modified_base (229)..(229): a, c, t, g, unknown or other
  misc_feature (229)..(229): n is a, c, g, or t
  modified_base (300)..(300): a, c, t, g, unknown or other
  misc_feature (300)..(300): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttataactatgtctctgtaccaacaacaccagacaaacgccccaaatcataattangagtcaactaagccggccctcgacggggtccctgactcgtcttcctctcgccctacaaggctagggccaaacgaccgggccctcccgtacgtacccgtcgtccgtcgggcctccgacggctaggaggtatggacggtctagtaattattaattcgacaagtctactaattagtcgcgtaacgggtactagttaacgaaagttggtagtaagttacggtttccggggaacgggaacggggaaacccctaaacgttaccgggttaaccccggtttacccgttaaggggtcccgaaccggacccccggtaaagggttaccccgttaaccccggttcccccccgtttaaccggg

SEQ ID NO: 323482 - DNA, 503 bp, Homo sapiens
  misc_feature: GZ8MTXP01A0UH8.4.39.D06.1.454.CMB.2.raw
  modified_base (294)..(294): a, c, t, g, unknown or other
  misc_feature (294)..(294): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactatgtctctgacaacaacaccagcaaagccccaaattcataattangagtcactaagcgccctcagggtccctgatcgcttcctctgcctccaaggctggcaacacggcctccctgaccgtctctggctccgaggcctgaggatgaggctgattatattgcagctcatatgcaggcagttacaatgtgaatgttcggcggttagggaaccaaacgttgacccgttcgtaaggtcaagcccaggctcgcccctcgg

SEQ ID NO: 323483 - DNA, 508 bp, Homo sapiens
  misc_feature: GZ8MTXP01DWNN4.4.39.D06.1.454.CMB.2.raw
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgacgttggtcttataactatgtctcctggaccaacaacacccaggcaaagccccaaatcataattangagtcactaagcgccctnacggggtccctgatcgcttcctctgcctccaaggctggcaacacggcctcccctgaccgtctcctgggctccaggctgaggatgaggctgattatattgnagctcatangngagactagtanatgngtaatgttcggacggacgaacaacttcgccgttcgtaagcaacgccgagttcctccgccccgtg

SEQ ID NO: 323484 - DNA, 534 bp, Homo sapiens
  misc_feature: GZ8MTXP01EBFXM.4.39.D06.1.454.CMB.2.raw
  modified_base (227)..(227): a, c, t, g, unknown or other
  misc_feature (227)..(227): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctctcactcagggcacagggtcctgggcccagtctgccctgactcagccctccctccgcgtccggtctcctggacagtcagtcaccatctcctgcactggaaccngcagtgacgttggtcttataactatgtctctggtaccaacaacaccaggcaaacgccccaaattcaataatttatgaggtacactaagcggccctcgacggggtccctgactcgcttcctctgcctccaaggctggccaacaccggccctccctgacccgtctcgtcgggctcgaggctggacggatgaggctgattattatgcgagctcatatgcagtacagttacaatgtgaatagttcggacggttaggaacctaattcggaccgttacgtaaggtcaacgcccgaaggctccgccccgtccgg

SEQ ID NO: 323485 - DNA, 535 bp, Homo sapiens
  misc_feature: GZ8MTXP01DV96D.4.39.D06.1.454.CMB.2.raw
  modified_base (227)..(227): a, c, t, g, unknown or other
  misc_feature (227)..(227): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttataactatgtctctggaccaacaacacccagcaaacgcccccaaattcaataatttatgagtcactaagcggccctcaggggtccctgatcgcttcctctgcctccaaggctggcaacacggcctccctgaccgtctctgggctccaggctgaggatgagctgattattattgcagctcatatgcaggactagttacaatgtgaattagttcgggcggttagggaacctaaacgttcgaaccgttccgtaagggtccaacggaccccgaagggccttccgcccccgttcgg

SEQ ID NO: 323486 - DNA, 536 bp, Homo sapiens
  misc_feature: GZ8MTXP01ECOW1.4.39.D06.1.454.CMB.2.raw
  modified_base (299)..(299): a, c, t, g, unknown or other
  misc_feature (299)..(299): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (442)..(442): a, c, t, g, unknown or other
  misc_feature (442)..(442): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctctgaccaacaacaccagcaaacgccccaaatcataattangagtcactagcgcctgagggtcctgatcgcttcctctgcctcaaggctggcaaacaccggccctccctgaccgtctcgtgggctccgaggctgagatgaggctgattattattgcagtcttanatangcgagtactagttaanagtgtagtaattacggttcgggacggaacggaaacctaaacgttcggaccgttacgtaacggtacaacggacccgacggcctcccgccccgtcg

SEQ ID NO: 323487 - DNA, 546 bp, Homo sapiens
  misc_feature: GZ8MTXP01ASU08.4.39.D06.1.454.CMB.2.raw
  modified_base (302)..(302): a, c, t, g, unknown or other
  misc_feature (302)..(302): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtacttataactatgtctcctggaccaacaacaccagcaaacgccccaaattcataattangagtcactaagcggccctcgacggggtccctgatcgcttcctctcgccctcaaggctcggcaaccgaccggccctcccgtcgacccgtctcgtgggctccgaggctggaggatggagctgatttatattgcagtctacatatgcgaggactaagttacaattgtgtaatcgttcggggacggttacggaaccaaacgttcgaccgttcgtaaggtcaacgcccaaggttcctccgccccgtcgg

SEQ ID NO: 323488 - DNA, 589 bp, Homo sapiens
  misc_feature: GZ8MTXP01EZB6E.4.39.D06.1.454.CMB.2.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccaccatctcctgcactggaaccngcagtgacgttggtcttaanaactatcgtctcctaggaaccaacaacaccaggacaaacgccccaaattcataatttangagtcaactaagccgccctgacgggtcccngactcgtcttccctctcgccctcgaacgctacggcaaacgcccggccttcccgtacgtacccgtctcgtcgggctccgaggctaggagatggagtctagtattattattgacagtcctnatncgcgaggctagtacaagtgtagaagttagttcggggacggttaaacggaacctaaacgttcggttacccgttacgtaacggtaccgaaccgacccggaacgggttcccttccggttccccccgttgg

SEQ ID NO: 323489 - DNA, 535 bp, Homo sapiens
  misc_feature: GZ8MTXP01D7XAI.4.39.D06.1.454.CMB.2.raw
  modified_base (424)..(424): a, c, t, g, unknown or other
  misc_feature (424)..(424): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctcctccgcgtccgggtctcctggacagtcagtcaccatctcctgcactggaaccagcagtgacgttggtcttatactatgtctctgacaacaacaccagcaaacgccccaatcataattatgagtcataagcgccctcgacgggtccctgactcgcttcctctgcctccaaggctggcaaacaccggccctccctgaccgtctctgggctccgaggctgaggatggagctgtattattattgcagcttanatagtgacgagtactaagttaactaagtgtagtaatacggttcgggacggaacggtaactaacgttcggttaccgttcgtaaggcaacgccgacggcctccgttccccgtg

SEQ ID NO: 323490 - DNA, 631 bp, Homo sapiens
  misc_feature: GZ8MTXP01BW74T.4.39.D06.1.454.CMB.2.raw
  modified_base (228)..(228): a, c, t, g, unknown or other
  misc_feature (228)..(228): n is a, c, g, or t
  modified_base (293)..(293): a, c, t, g, unknown or other
  misc_feature (293)..(293): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaaccngcagtgacgttggtcttatactatgtctctgaccaacacaccagcaaacgccccaatcatattangagtcactagcgccctcgacgggtcctgactcgcttcctctcgcctcaaggctggcaacgaccggccctcccgtgtacctctcgtcgggcctccgaggtctaggaggtacgtgggtacggtcgtaggtatttaatttagttcggacgtacggtcttactaattagtcgaccgtaaggtacctaaggttaaccaaagttggtagtaacgtttacggttcgggggaccgggttaaacggggtaaaccctaaacggttccggttaacccggttaccgttaacgggtaccgaaccggacccggtaacgggttcccgttccccggttcccccgtttaaccggg

SEQ ID NO: 323491 - DNA, 515 bp, Homo sapiens
  misc_feature: GZ8MTXP01DR1Q2.4.39.D06.1.454.CMB.2.raw
  modified_base (226)..(226): a, c, t, g, unknown or other
  misc_feature (226)..(226): n is a, c, g, or t
  modified_base (297)..(297): a, c, t, g, unknown or other
  misc_feature (297)..(297): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcaggcacagggtcctgggcccagtctgccctgactcagccctccctccgcgtccgggtctcctggacagtcagtcaccatctctgcactggaaccngcagtgacgttggtcttataactatgtctctggtaccaacaacaccagcaaacgccccaaatcataattangagtcactaagcgccctcagggtccctgatcgcttcctctgcctccaagctggcaacacggcctccctgaccgtctctgggctccaggctgagatgaggctgattattattgcagtctcatatgcgaggctagttacaatgtgtaatagttcgggacggacgggaaccaaacgttgccgttaccgtaaggtcaacgcccaggccttcgcccccgttcg

SEQ ID NO: 323492 - DNA, 543 bp, Homo sapiens
  misc_feature: GZ8MTXP01BGM5G.4.39.D06.1.454.CMB.2.raw
  modified_base (228)..(228): a, c, t, g, unknown or other
  misc_feature (228)..(228): n is a, c, g, or t
  modified_base (301)..(301): a, c, t, g, unknown or other
  misc_feature (301)..(301): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtcttataactatgtctcctggaccaacaacacccagcaaacgccccaaattcataattangagtcactaagcgccctgagggtccctgatcgcttcctctgcctcagctggcaacacggcctccctgaccgtctctggctccgagctgagatgaggctgattatattgctagctacatatcgcgaggactagttaacaattgtagaattacgttcgggacgggttagggaaacctaaacgttcggacccgttcgtaagggtccaacggaccccgaagggttcctccggttcccccgtccggg

SEQ ID NO: 323493 - DNA, 541 bp, Homo sapiens
  misc_feature: GZ8MTXP01DVBAL.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttaataactatgtctcctggtaccaacaacacccaggacaaacgcccccaaattcaataatttatgaggtcaactaagcggccctcgaggggtccctgatcgcttcctctgcctcaagctggcaacacggcctccctgaccgtctctggctccgaggctgaggatgaggctgattatattgctagctacatatgcaggactagttacaatgtgaatagttcgggacggttagggaaccaaacgttcggacccgttaccgtaagggtaccaacgccccaagggcctcgcccccgttcgg

SEQ ID NO: 323494 - DNA, 517 bp, Homo sapiens
  misc_feature: GZ8MTXP01EBPSQ.4.39.D06.1.454.CMB.2.raw
  modified_base (315)..(315): a, c, t, g, unknown or other
  misc_feature (315)..(315): n is a, c, g, or t
tcagagcactgtagcacgaccggtgctcgatttagtgacatctcgcagttctttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactatgtctctggaccaacaacaccaggcaaagccccaaatcataatttatgagtcactaagcggccctnagggtcctgatcgcttctctgcctccaaggctggcaacacggcctccctgaccgtctctgggctccaggctgagatgaggctgattattattgcagctcatatgcaggcagttacaatgtgaattgttcgggcggttaagggaacctaaaacgttcgaccgttccgtaaggtcaacgcccgaagggctccgcccccgttcgg

SEQ ID NO: 323495 - DNA, 519 bp, Homo sapiens
  misc_feature: GZ8MTXP01DSLN2.4.39.D06.1.454.CMB.2.raw
  modified_base (401)..(401): a, c, t, g, unknown or other
  misc_feature (401)..(401): n is a, c, g, or t
tcagagcactgtagcacgaccggtgctcgatttagtgacatctcgcagttctttggggagctctgggagaggagccccagccctgagattcccacgtgtttccattcagtgatcagcactgaacacagaggactcgccatggagtttgggctgagctgggttttccttgttgctatttaaaggtgtccaatgtgaggtgcaactggtggagtctgggggaagtgtggtacggcctgggggtccctgagactctcctgtacagcctctggatctcttgatgattatggcatgagctgggtccgccaagctccgagggaaggggctggagtgggtgtctggtatgaattggagtgggcggtgtacagcttatgcagactctgtgaagggccgattcaccatcnccagacgactaaacgcccaaaggaacctccctagtactctgacaattagaactgtctgagaagccgaggcacggcttgttattcttgtgcgaagaactagtttagggtgttgttaagg

SEQ ID NO: 323496 - DNA, 631 bp, Homo sapiens
  misc_feature: GZ8MTXP01DR6YU.4.39.D06.1.454.CMB.2.raw
  modified_base (218)..(218): a, c, t, g, unknown or other
  misc_feature (218)..(218): n is a, c, g, or t
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
tcagagcactgtagcacgaccggtgctcgatttagtgacatctcgcagttctttgggtttgggggaagtgtggtacggcctgggggtccctgagactctcctgtacagcctctggattctcctttgatgattatggcatgagctgggtccgccaagctccgagggaagggctggagtgggtgtctggtatgaattggagtggcggtagtacagcttangcagactctgtgaaggccattcacatctcagagacaacgccaaagaactccctgtatctgacaaattgaacagtctgagagccgaggacacggtccttgtattactgtgcgagaactagtttagggntgtagtggtaaaacngctgtcttagttcgtacgtacgttgggttacgtacgtacgtcggggacgagggacgtcccgtcggtacctaccgtcctcctcgacgtaccctacccgaaccgggaacggcccctacgttcccggttccccttcccccgtcggcccgtcccgtcgtccgtacccgacggacgcccgtacccgttaccggaacgaccgaccgaaccgaccggttcccggcccggtcgggccgtcggtccgtacggttaccgtaacggttaacccgttaacccg

SEQ ID NO: 323497 - DNA, 526 bp, Homo sapiens
  misc_feature: GZ8MTXP01AEHER.4.39.D06.1.454.CMB.2.raw
  modified_base (227)..(227): a, c, t, g, unknown or other
  misc_feature (227)..(227): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgtttggtcttataactatgtctctggaccaacaacaccaggcaaacgccccaaattcataatttatgagtcactaagcgcctcagggtccctgatcgcttcctctgcctccaagctggcaacacggcctccctgaccgtctctgggcctccgaggctgaggatgaggctgattattattgcagctcaatatgcaggcagttacaagtgtgaatagttcggcggttaacgggacctaaacgttgttacccgttccgtaagggtcaacgcccaaggcctcgccccgttaacgg

SEQ ID NO: 323498 - DNA, 520 bp, Homo sapiens
  misc_feature: GZ8MTXP01A2GV5.4.39.D06.1.454.CMB.2.raw
  modified_base (226)..(226): a, c, t, g, unknown or other
  misc_feature (226)..(226): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtcttataactatgtctcctggtaccaacaacaccaggacaaacgcccccaaattcaataatttatgagtcactaagcgccctcgagggtccctgatcgcttcctctgcctccaaggctggcaaacaccggccctcccgtgacccgtctctgggctccgaggctggaggatgaggctgattattattgcagctcatatgcaggcagttacaatgtgaatgttgggcggaggaccaaacgttgaccgttctaagggtcaacgcccaggcctcgcccccgttcg

SEQ ID NO: 323499 - DNA, 572 bp, Homo sapiens
  misc_feature: GZ8MTXP01EJVVS.4.39.D06.1.454.CMB.2.raw
  modified_base (228)..(228): a, c, t, g, unknown or other
  misc_feature (228)..(228): n is a, c, g, or t
  modified_base (421)..(421): a, c, t, g, unknown or other
  misc_feature (421)..(421): n is a, c, g, or t
  modified_base (450)..(450): a, c, t, g, unknown or other
  misc_feature (450)..(450): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacggggtcctgggcccagtctgccctgactcagcctccctccgcgtccgggtctcctggacagtcagtcaccatctcctgcactggaaccngcagtgacgttggtcgttataactatgtctcctggtaccaacaacacccaggacaaacgcccccaaattcataaatttatgaggtcactaagcggcctcgaggggtccctgactcgcttctcctcgcctcgaagctacgggacaacgaccggccctccctgacccgttctcgttcgggcctcgaggctgaggntgaggctagtattattagttgcaggtctnatatgcaggactaagttacaagttgtagtaataacggttcgggacgggtaacgggttaaccaaacgttcgaccgttcgttacggtcacggccctaagggccttccgtccccgtttggtcccc

SEQ ID NO: 323500 - DNA, 509 bp, Homo sapiens
  misc_feature: GZ8MTXP01BS6UI.4.39.D06.1.454.CMB.2.raw
  modified_base (226)..(226): a, c, t, g, unknown or other
  misc_feature (226)..(226): n is a, c, g, or t
  modified_base (319)..(319): a, c, t, g, unknown or other
  misc_feature (319)..(319): n is a, c, g, or t
tcagagcactgtagcacgaccggtgctcgatttagtgacatctcgcagttctttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttatactatgtctcctggtaccaacaacacccaggcaaagcccccaaattcataattatgagtcactaagcggccctnaggggtccctgatcgcttcctctgcctcaaggctggcaacacggcctccctgaccgtctctgggctccgaggctgaggatgaggctgattattattgcagcttcatatgcaggcagttacaatgtgaattagttcggacgagggaaccaaattcgacgttcctaaggtcaagcccaggcctcgcccctcg

SEQ ID NO: 323501 - DNA, 532 bp, Homo sapiens
  misc_feature: GZ8MTXP01B9N9C.4.39.D06.1.454.CMB.2.raw
  modified_base (296)..(296): a, c, t, g, unknown or other
  misc_feature (296)..(296): n is a, c, g, or t
  modified_base (432)..(432): a, c, t, g, unknown or other
  misc_feature (432)..(432): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcacatctcctgcactggaaccagcagtgacgttggtcttaatactatgtctctgaccaacaacaccagacaaacgccccaaatcataattangagtcactaagcgcctgacgggtcctgatcgcttcctctgcctccaagctggcaacaccggccctcccgtgacccgtctcgtcgggctccgaggctgaggatggaggctgtattagttattgctagcttacattangcaggctagttaacaatgtgtaattagttcgggacggaagggaacctaaagttcggaccgttcgtaacgggtcaacgacccgaggcctccgccccgtcgg

SEQ ID NO: 323502 - DNA, 580 bp, Homo sapiens
  misc_feature: GZ8MTXP01D9JU4.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctctgcactggaaccagcagtgacgttggtcttataactatgtctcctgaccaacaacaccaggacaaacgccccaaattcaataattatgagtacaactaagcggccctgacgggtccctgactcgcttcctctcgccctcaaggctggccaacgaccgggccctcccgtcgacccgtctcgtcgggctccgaggctggaggatggagctagatttattattcgctagtctacattagtgacgtaggtactaaggttaactaagttgttagaatttaggttcggggacggttaacgggaaacctaacgttcggttacccgttacgtaaggtaccaacgtacccgagttccgtcccgttcccgttccg

SEQ ID NO: 323503 - DNA, 541 bp, Homo sapiens
  misc_feature: GZ8MTXP01DT7XD.4.39.D06.1.454.CMB.2.raw
  modified_base (226)..(226): a, c, t, g, unknown or other
  misc_feature (226)..(226): n is a, c, g, or t
  modified_base (295)..(295): a, c, t, g, unknown or other
  misc_feature (295)..(295): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcacatctctgcactggaaccngcagtgacgttggtcttataactatgtctctgaccaacaacaccagcaaacgccccaaatcataattangagtcactaagcgccctgacgggtccctgatcgcttcctctgcctcaaggctggcaacgaccggccctccctgacccgtctcgtcgggctccgaggctgaggatgagctgtattattattgcgtagtctcatatgcaggactagttacaatgtgtaattagttcgggacggacgggaaacctaacgttcggttacccgttctaagggtcaacgccccgaaggccctaaccggcccccgttaacggg

SEQ ID NO: 323504 - DNA, 584 bp, Homo sapiens
  misc_feature: GZ8MTXP01BLQPX.4.39.D06.1.454.CMB.2.raw
  modified_base (297)..(297): a, c, t, g, unknown or other
  misc_feature (297)..(297): n is a, c, g, or t
  modified_base (430)..(430): a, c, t, g, unknown or other
  misc_feature (430)..(430): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctggtaccaacaacaccagcaaacgccccaaatcatattangagtcactaagcggccctgacggggtccctgatcgcttcctctgcctcaaggctggcaacaccggcctccctcgaccgtctcgtgggctccgaggctgaggatgaggctgattattattgctagcttcattangcgaggtactaagttactagttggtagtaagttacggttcggggacgggaaacgggtaaacccgtaaacggttccggttacccggttaccggtaacgggtaccgaaccggtaccccgtaacgggttccccgttaacccggttccccccgttcgg

SEQ ID NO: 323505 - DNA, 537 bp, Homo sapiens
  misc_feature: GZ8MTXP01DU8BQ.4.39.D06.1.454.CMB.2.raw
  modified_base (226)..(226): a, c, t, g, unknown or other
  misc_feature (226)..(226): n is a, c, g, or t
  modified_base (318)..(318): a, c, t, g, unknown or other
  misc_feature (318)..(318): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctctgcactggaaccngcagtgacgttggtcttataactatgtctctggtaccaacaacacccagcaaagcccccaaatcataatttatgagtcactaagcggccctnaggggtccctgatcgcttctctgcctccaaggcctggcaaacaccgggcctccctgacccgtctctgggctccaggctgaggatgaggctgattattattgcagcttcatatgcaggcagttacaatgtgaatagttcggacggagggaacctaacgttcgcccgttcctaagggttccaacggtccccgaaggggcccttcgcccccccgtttccggg

SEQ ID NO: 323506 - DNA, 540 bp, Homo sapiens
  misc_feature: GZ8MTXP01DVCH4.4.39.D06.1.454.CMB.2.raw
  modified_base (296)..(296): a, c, t, g, unknown or other
  misc_feature (296)..(296): n is a, c, g, or t
  modified_base (415)..(415): a, c, t, g, unknown or other
  misc_feature (415)..(415): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactatgtctctgaccaacaacaccagacaaagccccaaatcataattangagtcataagcgccctcagggtccctgatcgcttcctctgcctcaagctggcaaacacggccctccctgaccgtctctgggctccgaggctgagatgagctgattattattgcagctanatatgacgagactaagttacaagtgtagtaagttacggttcgggacgggaacggaaacctaaacgttcgttacccgttaccgtaaggtaccgaacgacccgaacggttcctcccgttccccgtcg

SEQ ID NO: 323507 - DNA, 569 bp, Homo sapiens
  misc_feature: GZ8MTXP01DRYLF.4.39.D06.1.454.CMB.2.raw
  modified_base (297)..(297): a, c, t, g, unknown or other
  misc_feature (297)..(297): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgacgttggtcttataactatgtctctgaccaacaacaccagcaaacgccccaaatcataattangagtcactagcgccctcgacgggtcctgatcgcttcctctgcctcaaggctggcaacaccggccctccctgaccgtctcgtcgggctccgaggctggaggatgaggctgattattattgcagtctcatatgcgaggtactagtttacaagttgtagtaattacgttcgggacgggttaaacgggtaaaccctaaaacgttcggaacccgttacgttaacgggtaccaaccggaccccgaaagggttcccttcccggaaccccccgttccggg

SEQ ID NO: 323508 - DNA, 530 bp, Homo sapiens
  misc_feature: GZ8MTXP01D3I96.4.39.D06.1.454.CMB.2.raw
  modified_base (228)..(228): a, c, t, g, unknown or other
  misc_feature (228)..(228): n is a, c, g, or t
  modified_base (297)..(297): a, c, t, g, unknown or other
  misc_feature (297)..(297): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctctcactcagggcacagggtcctgggcccagtctgccctgactcagccctccctccgcgtccgggtctcctggacagtcagtcaccatctcctgcactggaaccngcagtgacgttggtcttataactatgtctctgaccaacaacaccagcaaacgccccaaatcataattangagtcactaagcgccctgacgggtcctgatgcttctctgcctcaagctgcaacacgcctccctgaccgtctctggctccgaggctgagatgagctgattatattgcagctcatatgcaggcagttaacaattggtagtaagttaagttcggggacggaagggaaacctaaaacgttcgttacccgttaccgtaagggtaccaacgccccgaaggttcctccgcccccgttcgg

SEQ ID NO: 323509 - DNA, 512 bp, Homo sapiens
  misc_feature: GZ8MTXP01CXVP1.4.39.D06.1.454.CMB.2.raw
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
  modified_base (442)..(442): a, c, t, g, unknown or other
  misc_feature (442)..(442): n is a, c, g, or t
tcagagcactgtagcacgaccggtgctcgatttagtgacatctcgcagttctttgggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgacgttggtcttataactatgtctcctggtaccaacaacaccaggcaaagccccaaattcataatttangagtcactaagcggccctnaggggtccctgatcgcttcctctgcctccaagctggcaacacggcctcctgaccgtctctgggctccaggctgaggatgaggctgattattattgcagctcatatgcaggcagttacaatgtnaatattcgggcggagggtaaccaaagttcgcccgttctaaggtcaacgcccaaggcctcggccccctcgg

SEQ ID NO: 323510 - DNA, 534 bp, Homo sapiens
  misc_feature: GZ8MTXP01CBBGH.4.39.D06.1.454.CMB.2.raw
  modified_base (340)..(340): a, c, t, g, unknown or other
  misc_feature (340)..(340): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttatactatgtctcctggaccaacaacacccaggacaaagcccccaaattcataattatgagtcactagcgccctcgagggtccctgatcgcttccnctgcctcagctgcaacncgcctccngaccgtntctggctcgngctgagatgagctgattattattgcagtctcatatgcgaggctagttaacagttgtgtaattgttcggggacggaagggtaacccaaacgttcggacccgttccgtaagggtccaacggtccccgaagggttccctccggcccccgttccgg

SEQ ID NO: 323511 - DNA, 586 bp, Homo sapiens
  misc_feature: GZ8MTXP01CD07E.4.39.D06.1.454.CMB.2.raw
  modified_base (307)..(307): a, c, t, g, unknown or other
  misc_feature (307)..(307): n is a, c, g, or t
tcagagcactgtagcacgaccggtgctcgatttagtgacatctcgcagttcgtttggggggggtctcaggaggcagcgctctcaggacgtcaccaccatggcctgggctctgctcctcctcaccctcctcactcagggcacagggtcctgggcccagtctgccctgactcacgcccccctcgcgtccggtctcctggacagtcagtcaccatctcctgcactggaaccagcagtgacgttggtcttataactatgtctctggtaccaacaacacccaggacaaacgcccccaaattcaataatttangagtcactaagccggcctgagggtccctgatcgcttctccctgcctacgaaggctacggaccaacgaccggtcccttaccctcgacccgttcgtcgtcggggcctccgaggctggaggtagtggaggtctaggtatttattattgactaggcttacatatgacgaggctaagttactaagtgtacgagttaagtcgggacggtaacgggactaaaacgtcgttacccgttcgttacgggtccacggccccgaaggccttccgtccccgttcggtaaccc

SEQ ID NO: 323512 - DNA, 567 bp, Homo sapiens
  misc_feature: GZ8MTXP01APA3L.4.39.D06.1.454.CMB.2.raw
  modified_base (227)..(227): a, c, t, g, unknown or other
  misc_feature (227)..(227): n is a, c, g, or t
  modified_base (295)..(295): a, c, t, g, unknown or other
  misc_feature (295)..(295): n is a, c, g, or t
  modified_base (440)..(440): a, c, t, g, unknown or other
  misc_feature (440)..(440): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaaccngcagtgacgttggtcttatactatgtctctgaccaacacaccagacaaacgccccaaatcataattangagtcactagcgccctcgacgggtcctgactcgtcttcctctgccctcgaagctggccaacgaccggccctcccgtcgaccgtctcgtcgggctcgagctgagagtgagtctagtattattagttgacgtagtcttacagttagngcgtaggactaagttaacgtaatgtagtaagttacgttcgggacggttaacgggtaaccaaacgttcgaccgttacccgtaagggtccgaacggtacccgaacggttccctccggcccccgttccgg

SEQ ID NO: 323513 - DNA, 574 bp, Homo sapiens
  misc_feature: GZ8MTXP01DMGPJ.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttaataactatgtctcctggtaccaacaacaccaggacaaacgcccccaaattcaataatttatgagtcaactaagcggccctcgacgggggtccctgactcgctttcctctgccctccaaggcctgggcaaaccaccgggccctccctcgaccgtctcgtcgggctccgaggctggagatgaggctgattattattgcagctacatatgcaggtactaagttacaattggtgtaattagttcggggcggttaaacgggaacccaaacgttcgttacccgttaccgtaagggtacaacgcccgaagggttcccttccgcccccgttcgg

SEQ ID NO: 323514 - DNA, 546 bp, Homo sapiens
  misc_feature: GZ8MTXP01AJLTC.4.39.D06.1.454.CMB.2.raw
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctctgaccaacacaccagcaaacnccccaaatcatattangagtcatagcgcctcgacgggtcctgatcgcttctctgcctccaggctggcaaacgaccggccctccgtcgaccgtctcgtgggctccgaggctggagagtgaggctgtatttatattgctagtctacattagtgcaggtactaagttacaaagttggtgtaagttaagttccggggacgaacggggaaacctaaagttcggaaccgttcggtaagtcaacgtcccgaagggccctccggccccgttcgg

SEQ ID NO: 323515 - DNA, 567 bp, Homo sapiens
  misc_feature: GZ8MTXP01ES5YA.4.39.D06.1.454.CMB.2.raw
  modified_base (298)..(298): a, c, t, g, unknown or other
  misc_feature (298)..(298): n is a, c, g, or t
  modified_base (432)..(432): a, c, t, g, unknown or other
  misc_feature (432)..(432): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgacgttggtcttataactatgtctctgaccaacaacaccagacaaacgccccaaatcataattangagtcactaagcgccctcgacgggtcctgactcgcttcctctgcctacgaagctggcaacgacggccctccctgaccgtctcgtcgggctccgaggctggaggatggaggtctgtattattattgacagtctanatagtcgcgagtactaagttaatagtgtagtaagttaggttcgggacgggaaacggtaaacctaaacgttcgttaccgttaccgtaacggtaccaaccggtcccggaacggttcccgttcccgttcccccgtcgg

SEQ ID NO: 323516 - DNA, 497 bp, Homo sapiens
  misc_feature: GZ8MTXP01D8L6Q.4.39.D06.1.454.CMB.2.raw
  modified_base (226)..(226): a, c, t, g, unknown or other
  misc_feature (226)..(226): n is a, c, g, or t
  modified_base (314)..(314): a, c, t, g, unknown or other
  misc_feature (314)..(314): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctctcactcagggcacagggtcctgggcccagtctgccctgactcagcctccctccgcgtccggtctcctggacagtcagtcaccatctcctgcactggaaccngcagtgacgttggtcttatactatgtctctgaccaacaacaccagcaaacgccccaaatcaataattatgagtcactaagcggccctnacgggtcctgatcgcttcctctgcctccaagctgcaacaccggcctccctgaccgtctcgtggctccaggctgagatgaggctgattatatgcagctanatngnagactagtanatgtnaatgttcggacggaacggaactaacgttcgaccttcgtaagtcaacgccgagcctccgcccgtg

SEQ ID NO: 323517 - DNA, 586 bp, Homo sapiens
  misc_feature: GZ8MTXP01BR35K.4.39.D06.1.454.CMB.2.raw
  modified_base (228)..(228): a, c, t, g, unknown or other
  misc_feature (228)..(228): n is a, c, g, or t
  modified_base (320)..(320): a, c, t, g, unknown or other
  misc_feature (320)..(320): n is a, c, g, or t
  modified_base (342)..(342): a, c, t, g, unknown or other
  misc_feature (342)..(342): n is a, c, g, or t
  modified_base (393)..(393): a, c, t, g, unknown or other
  misc_feature (393)..(393): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtacttaataactatgtctcctggaccaacaacaccagacaaacgaccccaaatcataattatgagtcaatagcgccctnacggggtcctgactcgcttccntgcctccaagctgctaacaccggtccctccctagaccgtctcgtgggtccncgacggctcgaggacgtagacggtcgtagtagttatttaagttcgacgtacgtctactagttaagtgccgtagggtacctaatttacgtaaagttgtagtaagtagtttcgggacggttagggaaacctaagttacggccgttacgtaaggtcgaacgcccgaaaggttcctaaccgttccccgttaacccgg

SEQ ID NO: 323518 - DNA, 565 bp, Homo sapiens
  misc_feature: GZ8MTXP01DQPVP.4.39.D06.1.454.CMB.2.raw
  modified_base (226)..(226): a, c, t, g, unknown or other
  misc_feature (226)..(226): n is a, c, g, or t
  modified_base (296)..(296): a, c, t, g, unknown or other
  misc_feature (296)..(296): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcacatctctgcactggaaccngcagtgacgttggtcttataactatgtctctgaccaacaacaccagacaaacgccccaaatcataattangagtacactaagcgcctcgacgggtcctgactcgcttcctctcgcctccgaagctaggcaaacgaccggccctccctcgaccgtctcgtcgggctccgaggctggaggatggaggtctagtattattagttgacgtagtctacatagtgcgaggtactaagttaacaattggtagtaagttacggttaccggggacgggttaacggaaacctaaacgttcggacccgttacgtaacggtacaacgtacccgaggcctccgccccgtccg

SEQ ID NO: 323519 - DNA, 553 bp, Homo sapiens
  misc_feature: GZ8MTXP01D1KDM.4.39.D06.1.454.CMB.2.raw
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
  modified_base (317)..(317): a, c, t, g, unknown or other
  misc_feature (317)..(317): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctctcactcagggcacagggtcctgggcccagtctgccctgactcagccctccctccgcgtccggtctcctggacagtcagtcaccatctcctgcactggaaccngcagtgacgttggtcttataactatgtctcctggtaccaacaacacccaggcaaagccccaaattcatattangagtcactagcgccctnagggtccctgatcgcttcctctgcctccaaggcctggcaacaccggcctccctgaccgtctctgggctccgaggctgagatgagctgattattattgcagctacatatgcaggactagttacaattgtgaattgttcgggacgggttaacgggaaccctaaaacgttccggttacccggttccgtaacgggtacaacggccccgaaagggttccctccggttccccccgttccggg

SEQ ID NO: 323520 - DNA, 541 bp, Homo sapiens
  misc_feature: GZ8MTXP01BUJHE.4.39.D06.1.454.CMB.2.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttataactatgtctcctggtaccaacaacacccaggcaaacgcccccaaattcataatttangagtcactaagcggccctgaggggtccctgactcgcttcctctgccctccaaggctggcaacgaccggccctccctgaccgtctcgtgggctccgaggctgaggatggaggctgattattattgcagctcatatgcaggctagttaacaatgtgaattagttcggcggttagggaaccaaacgttcgaccgttccgtaaggtccaacgcccaagggttcctccggcccccgttcgg

SEQ ID NO: 323521 - DNA, 571 bp, Homo sapiens
  misc_feature: GZ8MTXP01EA2A0.4.39.D06.1.454.CMB.2.raw
  modified_base (229)..(229): a, c, t, g, unknown or other
  misc_feature (229)..(229): n is a, c, g, or t
  modified_base (300)..(300): a, c, t, g, unknown or other
  misc_feature (300)..(300): n is a, c, g, or t
  modified_base (479)..(479): a, c, t, g, unknown or other
  misc_feature (479)..(479): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttaatactatgtctctgaccaacaacaccagacaaacgccccaaatcaataattangagtcaactaacgcgccctgacgggtccctgatcgtcttcctctgccctacaacggctcggcaacgaccggtccctcccgtgtacccgtctcgtgggcctccgaggctaggaggaatggacggtctagtaatttagttagttgacctagtcctataatagtgcgaggtactaagttaanagtgtagtaagttacggttcgggacggaacgtaactaacgttcgttaccgttcgtaagaccgaacgaccgacgttccgtcccgttcccgtcg

SEQ ID NO: 323522 - DNA, 569 bp, Homo sapiens
  misc_feature: GZ8MTXP01D1YTO.4.39.D06.1.454.CMB.2.raw
  modified_base (301)..(301): a, c, t, g, unknown or other
  misc_feature (301)..(301): n is a, c, g, or t
  modified_base (342)..(342): a, c, t, g, unknown or other
  misc_feature (342)..(342): n is a, c, g, or t
tcagagcactgtagcacgaccggtgctcgatttagtgacatctcgcagttcgtttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgacgttggtcttaataactatgtctctgaccaacaacaccagacaaacgccccaaatcataattangagtacactagcgccctgacggggtccctgactcgcttccnctcgcctaccaaggctggcaaacaccgggtccctccccgtcggacccgtcgttccgtcgggtcctccgaggcgttaggaggtagtgaagggtctagtaatttattagttcgacaagtctactaagtatcgcaggtactagttaacaagttgtagaattgttcgggacggaggaaacctaattcggaccgttcgtaaggtcaacggaccaggcctcccgcccgttccg

SEQ ID NO: 323523 - DNA, 532 bp, Homo sapiens
  misc_feature: GZ8MTXP01DNR42.4.39.D06.1.454.CMB.2.raw
  modified_base (233)..(233): a, c, t, g, unknown or other
  misc_feature (233)..(233): n is a, c, g, or t
  modified_base (302)..(302): a, c, t, g, unknown or other
  misc_feature (302)..(302): n is a, c, g, or t
  modified_base (370)..(370): a, c, t, g, unknown or other
  misc_feature (370)..(370): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtccaccatcctcctgcactaggaaccngcagtgacgttggtacttaataactatgtctctgaccaacacaccagacaaacgccccaatcatattangagtacatagcgccctgacgggtccctgatcgtcttcctctcgcctcgaagctgcaacgcgccctccngaccgtctcgtggctcgagctgagatgaggtctgtattattattgactagtcttanattagngcgaggactagttacaatgtagaattgttcgggcggttaggaaacctaaagttcgttaccgttaccgtggtacaacgcccgaaggcctccgccccgttcg

SEQ ID NO: 323524 - DNA, 531 bp, Homo sapiens
  misc_feature: GZ8MTXP01CGJG5.4.39.D06.1.454.CMB.2.raw
  modified_base (374)..(374): a, c, t, g, unknown or other
  misc_feature (374)..(374): n is a, c, g, or t
  modified_base (449)..(449): a, c, t, g, unknown or other
  misc_feature (449)..(449): n is a, c, g, or t
tcagagcactgtagcacgaccggtgctcgatttagtgacatctcgcagttctttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacaacaccaggcaaacgcccccaaattcataatttatgagtcactaagcgccctcaggggtccctgatcgcttcctctgcctccaaggctggcaacaccggccctcccngacccgtctctcgggctccgaggctgaggatgagctgattatattgcagtctcatatgcaggcagttacaatgtnaatagttcggcggaagggtaaccaaacgttcgaccgttaccgtaaggtcaacgtcccaacgggttcctccgcccccgttcgg

SEQ ID NO: 323525 - DNA, 509 bp, Homo sapiens
  misc_feature: GZ8MTXP01EGPOY.4.39.D06.1.454.CMB.2.raw
  modified_base (268)..(268): a, c, t, g, unknown or other
  misc_feature (268)..(268): n is a, c, g, or t
  modified_base (356)..(356): a, c, t, g, unknown or other
  misc_feature (356)..(356): n is a, c, g, or t
  modified_base (495)..(495): a, c, t, g, unknown or other
  misc_feature (495)..(495): n is a, c, g, or t
tcagagcactgtagcacgaccggtgctcgatttagtgacatctcgcagttctttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataattangaggtcactaagcggccctcagggtccctgatcgcttctctgcctcaaggctggcaacacggcctcctgacctctctggctcagctgngatgagctgattatatgcagctcatatgcagcagttacaatgtgattagttcgggacggtagggaccaaacgtgaccgtactaggtccagccgaaggctcgcccctcggttcactcttcgttccccgcctctcctaacngtcgctgttcgcgg

SEQ ID NO: 323526 - DNA, 499 bp, Homo sapiens
  misc_feature: GZ8MTXP01BU02M.4.39.D06.1.454.CMB.2.raw
  modified_base (297)..(297): a, c, t, g, unknown or other
  misc_feature (297)..(297): n is a, c, g, or t
  modified_base (335)..(335): a, c, t, g, unknown or other
  misc_feature (335)..(335): n is a, c, g, or t
  modified_base (417)..(417): a, c, t, g, unknown or other
  misc_feature (417)..(417): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgaccaacaacaccagcaaacgccccaaatcataattangagtcactaagcgccctgagggtccctgatcgcttccnctgcctccaagctggcaacaccggcctccctgaccgtctctggctccagctgagatgagctgattatattgcagctcattangcagcagttacaatgtgaatagttcggaggaggaccaattcgaccgttctaaggtcaacgtcccaaggcctcgccccgtcgg

SEQ ID NO: 323527 - DNA, 527 bp, Homo sapiens
  misc_feature: GZ8MTXP01AZM4W.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgacgttggtcttataactatgtctctggtaccaacaacaccaggcaaacgccccaaattcataatttatgagtcactaagcgccctcaggggtccctgactcgcttcctctgcctcaaggctggcaacacggcctccctgaccgtctcgtgggctccgaggctggaggatgaggctgattattattgcagtctcatatgcaggcagttacaattgtgaattagttcgggcggagggaacccaaacgttcgaccgttactaagggtcaacgcccgaaggcctcggcccccgtcgg

SEQ ID NO: 323528 - DNA, 530 bp, Homo sapiens
  misc_feature: GZ8MTXP01D6BCN.4.39.D06.1.454.CMB.2.raw
  modified_base (298)..(298): a, c, t, g, unknown or other
  misc_feature (298)..(298): n is a, c, g, or t
  modified_base (338)..(338): a, c, t, g, unknown or other
  misc_feature (338)..(338): n is a, c, g, or t
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttataactatgtctctgaccaacacaccagcaaacgccccaaattcataattangagtacactaagcgccctcacgggtccctgactcgcttcnctgctcaagctgcaacacggcctcctgaccgtctctcggctccaggctgaggatgagctnattattatgcgantcatatgnagactagtataatagtgtaagtaagttacggtacgggacgggaaccgaaacgttaacgaccgttaccgtaacgttacgaacgaccgacggacgtccgttcccgttccccgg

SEQ ID NO: 323529 - DNA, 555 bp, Homo sapiens
  misc_feature: GZ8MTXP01DTHZ0.4.39.D06.1.454.CMB.2.raw
  modified_base (300)..(300): a, c, t, g, unknown or other
  misc_feature (300)..(300): n is a, c, g, or t
  modified_base (433)..(433): a, c, t, g, unknown or other
  misc_feature (433)..(433): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctgaccaacaacaccagacaaacgccccaaatcaataattangagtcactaagcgccctgacgggtcctgactcgcttcctctgcctcaaggctggcaaacgaccggccctccctcgaccgtctcgtcgggctccgaggctgaggatgagctgattattatgcagtctcattagngacgaggactaagttaactagtgtagtaagttacggttcgggacggaacggaaacctaaacgttcgttacccgttaccgtaaggtaccaaccggacccgaacggccctcccgttccccgtcg

SEQ ID NO: 323530 - DNA, 509 bp, Homo sapiens
  misc_feature: GZ8MTXP01B06KE.4.39.D06.1.454.CMB.2.raw
  modified_base (227)..(227): a, c, t, g, unknown or other
  misc_feature (227)..(227): n is a, c, g, or t
  modified_base (321)..(321): a, c, t, g, unknown or other
  misc_feature (321)..(321): n is a, c, g, or t
  modified_base (339)..(339): a, c, t, g, unknown or other
  misc_feature (339)..(339): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (407)..(407): a, c, t, g, unknown or other
  misc_feature (407)..(407): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctcctccgcgtccggtctcctggacagtcagtcaccatctcctgcactggaaccngcagtgacgttggtcttaataactatgtctcctggtaccaacaacacccaggcaaacgccccaaattcataattatgagtcactaagcgccctnagggtcctgatcgcttcnctgcctcagctgcacncgctccngacctntcnggctccaggctgagatgagctgattatattgcagtntacatatgcaggtcaagttacaatgtataatagttcgggacggaagggaacctaaagttcgaccgttcgaaggtcaacgacccaggcctccgcccccgttgg

SEQ ID NO: 323531 - DNA, 558 bp, Homo sapiens
  misc_feature: GZ8MTXP01AQZYT.4.39.D06.1.454.CMB.2.raw
  modified_base (293)..(293): a, c, t, g, unknown or other
  misc_feature (293)..(293): n is a, c, g, or t
  modified_base (439)..(439): a, c, t, g, unknown or other
  misc_feature (439)..(439): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcactggaaccagcagtgacgttgtcttatactatgtctctgaccaacacaccagcaaacgccccaaatcataattangagtcactagcgccctcgacgggtcctgactcgcttcctctcgccctcaaggctcggcaacgccggtccctccccgtcgacccgttctccgtcgggcctaccgaggccgtggaggtagtggagtctagtattattattgcagtctnatatgcagctagttacatgtgtaattagttcgggacggttaggaacctaaacgttcggttacccgttcggtaacggtccgaacggtaccccgaagggccctccggttcccccgttccgg

SEQ ID NO: 323532 - DNA, 628 bp, Homo sapiens
  misc_feature: GZ8MTXP01DJJ6H.4.39.D06.1.454.CMB.2.raw
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (287)..(287): a, c, t, g, unknown or other
  misc_feature (287)..(287): n is a, c, g, or t
  modified_base (359)..(359): a, c, t, g, unknown or other
  misc_feature (359)..(359): n is a, c, g, or t
tcagagcactgtagcacgaccggtgctcgatttagtgacatctcgcagttctttgggttttgggggaagtgtggtacggcctggggggtccctgagactctcctgtacagcctctggattctcctttgatgattatggcatgagctgggtccgccaagctccgagggaagggctggagtgggtgtctggtatgaattggagtggcggtagtacagcttatgcagactctgtgaaggccattcacatcnccaganacaacgcaagactccctgatctgcaattgaacngtctgagagccgaggacacggtcttgtatacgtgtgcgagaactagtttagggtgtgtaagtcggtaaaacngtctgcttagttcgtcgacgtttggggtttcgacgtacgtcgggggccgaggggtacgcccgtgggtcctaccgtcctcctaccgacgcccgtacccgaaccggaaccggggccctacgttcccgggttccccttccccccgtgggccccgtcccctcgccctacccgacgggaccgcctaacccgttcccggaacgacgccaacgacggccggttcccgtcggggcctcggtcccgtgggttaccgtaaacggttcccgtttaacccg

SEQ ID NO: 323533 - DNA, 542 bp, Homo sapiens
  misc_feature: GZ8MTXP01BHR9S.4.39.D06.1.454.CMB.2.raw
  modified_base (229)..(229): a, c, t, g, unknown or other
  misc_feature (229)..(229): n is a, c, g, or t
  modified_base (296)..(296): a, c, t, g, unknown or other
  misc_feature (296)..(296): n is a, c, g, or t
  modified_base (355)..(355): a, c, t, g, unknown or other
  misc_feature (355)..(355): n is a, c, g, or t
  modified_base (432)..(432): a, c, t, g, unknown or other
  misc_feature (432)..(432): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcttatactatgtctctgaccaacacaccagcaaacgccccaattcataattangagtcactaagcgccctgacgggtccctgatcgcttcctctgcctcaaggctggcaacncggccctccctgaccgtctcgtgggctccgaggctggagtatgaggctgatttatattcgcgtagtctacattacgngacgagtactaagttaacagttgtagtaacttaggttcgggacggaacggaaccaacgttcgttaccgttacgtaagtccaacgcccgacggttcctccgttccccgtcg

SEQ ID NO: 323534 - DNA, 563 bp, Homo sapiens
  misc_feature: GZ8MTXP01BHX2W.4.39.D06.1.454.CMB.2.raw
  modified_base (230)..(230): a, c, t, g, unknown or other
  misc_feature (230)..(230): n is a, c, g, or t
  modified_base (301)..(301): a, c, t, g, unknown or other
  misc_feature (301)..(301): n is a, c, g, or t
  modified_base (460)..(460): a, c, t, g, unknown or other
  misc_feature (460)..(460): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcttaatactatgtctctgaaccaacaacaccagacaaacgccccaaatcataattangagtcactagcgccctcgacgggtccctgactcgtcttccctctcgccctaccgaaggctacggccaaaccgacccgggtccctcccgtcgtacccgtctcgtcgggcctccgaggctaggagagtggagtctagtattattatgcgagtctcagttangcgagtactattaacagtgtagaattaggttcgggacggaagggtaacctaacgttcgaccgttaccgtaagccaacgacccgaggttcctccgccccgtcgg

SEQ ID NO: 323535 - DNA, 578 bp, Homo sapiens
  misc_feature: GZ8MTXP01AOJKP.4.39.D06.1.454.CMB.2.raw
  modified_base (293)..(293): a, c, t, g, unknown or other
  misc_feature (293)..(293): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttgtcttatactatgtctctgaccaacacaccagcaaacgccccaatcatattangagtcactaagcgccctgacggggtccctgactcgcttcctctgcctcgaagctggcaacgaccggccctcccgtgtaccgtctcgcgggctccgaggctggaggatggagctagtatttattattgcgagtctcaatgtgcaggtctaagttacaagttgtagtaagttaggttcggggaacgggaagggaaacccgtaaaacgttcggttaaaccccggttccggtaagggttacccgaaccgaccccggaacggggttccccttccggccccccgttaacgg

SEQ ID NO: 323536 - DNA, 556 bp, Homo sapiens
  misc_feature: GZ8MTXP01EJX6C.4.39.D06.1.454.CMB.2.raw
  modified_base (297)..(297): a, c, t, g, unknown or other
  misc_feature (297)..(297): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctctggaccaacaacaccagcaaacgccccaatcatattangagtcatagcgccctcgaggggtcctgactcgtcttcctctcgccctcaaggctcggcaaacaccggcctcccgtgaccgtctcgtcgggctcgaggctggaggatgaggtctagtattattattgacgtagtctacatatgacaggtacagttacaagtgtagtaattaagttcggggacggttaacgggaacctaaaacgttcgacccgttaccgtaagggtaccaacgtccccgaaggccctccgcccccgttcgg

SEQ ID NO: 323537 - DNA, 514 bp, Homo sapiens
  misc_feature: GZ8MTXP01B8EIG.4.39.D06.1.454.CMB.2.raw
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
  modified_base (361)..(361): a, c, t, g, unknown or other
  misc_feature (361)..(361): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgacaacacaccagcaaacnccccaaatcatattangagtcatagcgccctgacgggtcctgatcgcttcctctgcctcaagctggcaacgacggccctccgngaccgtctcgtggctcgaggctgagatgagtctgtattattatgcagtctnattangacaggactaagttaacaattgtgtaataggttcggaggttacggaaaccaagttcgaccgttcgtaaggtcgaacgccgaggcctcggccccgtcg

SEQ ID NO: 323538 - DNA, 571 bp, Homo sapiens
  misc_feature: GZ8MTXP01CEKMK.4.39.D06.1.454.CMB.2.raw
  modified_base (228)..(228): a, c, t, g, unknown or other
  misc_feature (228)..(228): n is a, c, g, or t
  modified_base (307)..(307): a, c, t, g, unknown or other
  misc_feature (307)..(307): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtcttataactatgtctcctggtaccaacaacacccaggacaaacgcccccaaattcaataatttangaggtcactaagcggccctcgaggggtccctgactcgtcttcctctgcctccgaaggctggccaacgaccggccctcccgtgacccgtctcgtcgggtcctccgagggctggagggtatggaggtcttgtattattatttgacgtagcttcattagtgcgaggactagttaacaagttgtagtaattaggttcgggcggacgggaaccaagttcggttacccgttcgtaacggtcaacgtcccagggcctccgcccccgttcgg

SEQ ID NO: 323539 - DNA, 549 bp, Homo sapiens
  misc_feature: GZ8MTXP01EDELI.4.39.D06.1.454.CMB.2.raw
  modified_base (304)..(304): a, c, t, g, unknown or other
  misc_feature (304)..(304): n is a, c, g, or t
  modified_base (340)..(340): a, c, t, g, unknown or other
  misc_feature (340)..(340): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgacgttggtacgttataactatgtctcctagaccaacaacaccagacaaacgccccaaatcaataattangagtcatagcgccctcgagggtcctgatcgcttccnctcgcctcgaagctggcaacgaccgccctccctgaccgtctcgtgggctccgaggctgaggtatcggaggctgtattattattgctagtctacatagtgacgtaggactagttaacaagttgtgaattaaggttcggacgggttaaggaaacctaacttcggttccgttcgtaagggtaccaacgcccgaaggccttccgccccgttcg

SEQ ID NO: 323540 - DNA, 640 bp, Homo sapiens
  misc_feature: GZ8MTXP01B777E.4.39.D06.1.454.CMB.2.raw
  modified_base (229)..(229): a, c, t, g, unknown or other
  misc_feature (229)..(229): n is a, c, g, or t
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccngcagtgacgttggtcttatactatgtctctgaccaacaacaccagacaaacnccccaaatcataattangagtcactaagccgcctcgacgggtcctgactcgcttcctctcgccctccgaaggtcctacggccaaaccgacccgggtccccttccccgtcgaccccgttctccgtcgggcctccgaggctcggaggtactgggacgtcttagtaatttaagttagttcggactaaggtccttacgaagtttacgcgtaccgaagggtaccttaaggtttaaacgtaagttgggtagttaaacggttggtttaccggggacgggaaacgggtaaaccctaaacgttcggttacccgttaccgtaacggtaccaacggccccgaaggttcccgtcccggttcccccgttcgg

SEQ ID NO: 323541 - DNA, 530 bp, Homo sapiens
  misc_feature: GZ8MTXP01DNEXL.4.39.D06.1.454.CMB.2.raw
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
  modified_base (338)..(338): a, c, t, g, unknown or other
  misc_feature (338)..(338): n is a, c, g, or t
  modified_base (370)..(370): a, c, t, g, unknown or other
  misc_feature (370)..(370): n is a, c, g, or t
  modified_base (407)..(407): a, c, t, g, unknown or other
  misc_feature (407)..(407): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctcctcgcgtccggtctcctggacagtcagtcaccatctcngcactggaaccngcagtgacgttggtcttaataactatgtctctggtaccaacaacaccagacaaacgccccaaattcaataatttangagtcaataagcggccctnagggtcctgatcgcttcnctgcctcgaaggctgcaaacaccggccctccncgaccgtctctggctccaggctgagatgagctgattntatgcagctacatatgcgaggacagttaacaatggtataacgtaagttcgggacggaacgggaacctaaacgttgcccgttactaagggtcaacgggcccaagggccttccgcccccgttcgg

SEQ ID NO: 323542 - DNA, 655 bp, Homo sapiens
  misc_feature: GZ8MTXP01BGQUR.4.39.D06.1.454.CMB.2.raw
  modified_base (229)..(229): a, c, t, g, unknown or other
  misc_feature (229)..(229): n is a, c, g, or t
  modified_base (300)..(300): a, c, t, g, unknown or other
  misc_feature (300)..(300): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttataactatgtctcctgaccaacaacaccagacaaacgccccaaatcataattangagtcactaagcgccctcgacggggtccctagactcgctttccctctcgccctaccgaacggtcctacggccgaaaccgtacccgggtccccttccccgtacggtacccgttccttccgtcggggccttcccggagggtcctagggacggtagtgggtaacgggtcttaggttaatttattagttcggactaggtcttacattagcgacagggtactaagttaacaagttggtacgtaaagttacggttccggggaacggggttaacgggtaaaccctaaaacggttcggttaaccccgttacgtaacggtaccaacggaccccggaacggttcccgtcccgttcccccgttcgg

SEQ ID NO: 323543 - DNA, 580 bp, Homo sapiens
  misc_feature: GZ8MTXP01DROL3.4.39.D06.1.454.CMB.2.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttaataatntgtctctgaccaacaacaccagacaaacgccccaaatcaataattangagtcactaagcgccctcgacgggtcctgatcgcttcctctgcctcagctggcaacgcgccctccgtcgaccgtctcgcggctcgaggctgagatggagtctgtattagttattgcagtcttcatagtcgcgaggtactagttaacaagttgtagtaagttacggttccggggacgggaaacgggtaaaccctaaacgttccgggttaacccgttaccggtaaggttacccgaaccggtacccggaacggggttccctaacccggttcccccgttcccgg

SEQ ID NO: 323544 - DNA, 515 bp, Homo sapiens
  misc_feature: GZ8MTXP01EKMSI.4.39.D06.1.454.CMB.2.raw
  modified_base (230)..(230): a, c, t, g, unknown or other
  misc_feature (230)..(230): n is a, c, g, or t
  modified_base (300)..(300): a, c, t, g, unknown or other
  misc_feature (300)..(300): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcttataactatgtctctgaccaacacaccagcaaacgccccaaattcaataattangagtcactaagcgccctcgagggtccctgattgcttcctctgcctcaaggctggcaaacaccgcctccctagccgtctcgtggcctccgagctgagatgagctagattagtatgcagtctanatangcgagactagtanatgtntaagtagttcgggacggaacgaacctaagttccgccgttacgtaagcaacgccgagcctccgttccccgtg

SEQ ID NO: 323545 - DNA, 591 bp, Homo sapiens
  misc_feature: GZ8MTXP01A1G5Q.4.39.D06.1.454.CMB.2.raw
  modified_base (226)..(226): a, c, t, g, unknown or other
  misc_feature (226)..(226): n is a, c, g, or t
  modified_base (291)..(291): a, c, t, g, unknown or other
  misc_feature (291)..(291): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctcctgcactgaaaccngcagtgacgttggtacttatactatgtctctgaccaacacaccagacaacacccaatcatattangagtacactagcgccctcgacgggtcctgactcgtcttcctctcgccctaccgaacggtctacggccaaaccgaccggtccctcccgtcgtacccgttctcgtcgggcctccgaggtcgtaggaggtagtggacggtctagttaatttagttagttcgacgtagtccttacaagttagtcgacgtaggtactaagttaacaagttgtagtaattacggttcgggacggaacggaaacctaaacgttcgttaccgttacgtaacggtccaacgacccgacggttccctccgttccccgtcg

SEQ ID NO: 323546 - DNA, 565 bp, Homo sapiens
  misc_feature: GZ8MTXP01DM00I.4.39.D06.1.454.CMB.2.raw
  modified_base (227)..(227): a, c, t, g, unknown or other
  misc_feature (227)..(227): n is a, c, g, or t
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcatggaaccngcagtgacgttggtcgttataactatgtctctgaccaacaacaccagcaaacnccccaaatcatattangagtcactaagcgccctcgagggtccctgatcgtcttcctctgcctccaaggctggccaacgaccggcctccctcgaccgtctcgtcgggctccgaggcttaggagtagagtctgtattattatgcaggtctcatatcgcgaggactagttaataagttgtgtagttaagttcgggacgggtaacgggaaccgtaaacgttcggttacccggttcgttacgggtaaccacggaacccgtaacggtccgttccgtcccccgttcggtccc

SEQ ID NO: 323547 - DNA, 522 bp, Homo sapiens
  misc_feature: GZ8MTXP01AIGS0.4.39.D06.1.454.CMB.2.raw
  modified_base (294)..(294): a, c, t, g, unknown or other
  misc_feature (294)..(294): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcactggaaccagcagtgacgttggtcttataactatgtctctgaccaacacaccagacaaagccccaaatcataattangagtcactaagcgccctcgacgggtcctgatcgtcttcctctgcctccaaggctggcaacaccggcctccctgaccgtctcgtgggcctccgaggctggaggatgagtctgattattattgcagctanatangcgaggctagttacaattgtgtaatgttcgggcggacggaacctaacgttcgaccgttacgtaaggtcaacgtccagggcctcccggcccgtccgg

SEQ ID NO: 323548 - DNA, 506 bp, Homo sapiens
  misc_feature: GZ8MTXP01A6O3Y.4.39.D06.1.454.CMB.2.raw
  modified_base (227)..(227): a, c, t, g, unknown or other
  misc_feature (227)..(227): n is a, c, g, or t
  modified_base (299)..(299): a, c, t, g, unknown or other
  misc_feature (299)..(299): n is a, c, g, or t
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtcttataactatgtctctggaccaacaacacccagcaaagcccccaaattcataattangagtcactaagcgccctcgagggtccctgatcgcttcctctgcctcaaggctggcaacacggcctccctgacctctcngggctccgagctgagatgagctgattatattgntagctanatangngagtnagtanatgagtaatgttcgggacggacggaacaacgttcgaccgttcgtaacggcaacgccgacgcgtccgcccgtcg

SEQ ID NO: 323549 - DNA, 615 bp, Homo sapiens
  misc_feature: GZ8MTXP01COZX3.4.39.D06.1.454.CMB.2.raw
  modified_base (232)..(232): a, c, t, g, unknown or other
  misc_feature (232)..(232): n is a, c, g, or t
  modified_base (263)..(263): a, c, t, g, unknown or other
  misc_feature (263)..(263): n is a, c, g, or t
  modified_base (298)..(298): a, c, t, g, unknown or other
  misc_feature (298)..(298): n is a, c, g, or t
tcagagcactgtagcacgaccggtgctcgatttagtgacatctcgcagttcgtttggggggggtctcaggaggcagcgctctcaggacgtcaccaccatggcctgggctctgctcctcctcaccctcctcactcagggcacagggtcctgggcccagtctgccctgactcagccctccctccgcgtccaggtcctcctggacagtcagtcaccatctcctgcactggaaccngcagtgacgttggtcgttatactatgtctcngtacaacacaccagcaacgccccaatcataattangagtcactaagccgcctcgacgggtccctgactcgtcccttctctgccctccgaaagctcgggacaaaccgaccggtccctcccgtcgtaccgtctcgtcgggcctcgaggctgggagtagtggaggtcttagtaatttagttaagttcggggactacggtcttaccgtaattaacgttcgacgtagggtacctaaagggttaactaaagttgggtaagtaaggtttaaccggttacgggaccgggtaaacgggaaccttaaacgttcggacccgttcgtacggtcgacggtacccgacgggcccttcggtcccccg

SEQ ID NO: 323550 - DNA, 531 bp, Homo sapiens
  misc_feature: GZ8MTXP01AOYMU.4.39.D06.1.454.CMB.2.raw
  modified_base (227)..(227): a, c, t, g, unknown or other
  misc_feature (227)..(227): n is a, c, g, or t
  modified_base (298)..(298): a, c, t, g, unknown or other
  misc_feature (298)..(298): n is a, c, g, or t
  modified_base (376)..(376): a, c, t, g, unknown or other
  misc_feature (376)..(376): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaaccngcagtgacgttggtcttatactatgtctctggaccaacaacaccaggcaaacgccccaaattcataattangagtcactagcggccctcacggggtccctgactcgcttcctctgccctccaaggctggccaacgaccgggccctcccngaccgtctctgggctcgaggctggaggatgaggtctgattattattgctagctcattatgcaggctaagttacaattgagtaatagttcgggcggttaagggaacctaaagttcgaccgttcgtaaggtcaacgccgaggcctccgccccgtcgg

SEQ ID NO: 323551 - DNA, 577 bp, Homo sapiens
  misc_feature: GZ8MTXP01A2E5U.4.39.D06.1.454.CMB.2.raw
  modified_base (297)..(297): a, c, t, g, unknown or other
  misc_feature (297)..(297): n is a, c, g, or t
  modified_base (430)..(430): a, c, t, g, unknown or other
  misc_feature (430)..(430): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgaccaacaacaccagcaaagccccaaattcataattangagtcactaagcgccctcgacggggtcctgactcgcttcctctgcctcagctggcaacacgcctccctgaccgtctcgtcgggctccgaggctggaggacgtgacggtctagatttattattcgcgtagtctnattagtgcgaggtactagttaacaagttcggtgtaattacggttcgggacgggttaacggaacccgtaaaacgttcggttaacccgttaccgttaagggtcctaacggcccccgaaaggttccccgttccgttcccccccgttcggg

SEQ ID NO: 323552 - DNA, 559 bp, Homo sapiens
  misc_feature: GZ8MTXP01AINHM.4.39.D06.1.454.CMB.2.raw
  modified_base (229)..(229): a, c, t, g, unknown or other
  misc_feature (229)..(229): n is a, c, g, or t
  modified_base (335)..(335): a, c, t, g, unknown or other
  misc_feature (335)..(335): n is a, c, g, or t
  modified_base (346)..(346): a, c, t, g, unknown or other
  misc_feature (346)..(346): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
  modified_base (466)..(466): a, c, t, g, unknown or other
  misc_feature (466)..(466): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttataactatgtctctagaccaacaacaccaggacaaacgccccaaattcaataatttatgaggtcactaagcggccctgacggggtcccngatcgcttccnctcgcctcagctcggcaacgaccggccctccctcgaccgtctcgtcgggctccgaggctggacggagtcggagtctagtatttagtattgcagtcctanattacgngcgagactagttanagtgtagtaagtacggttcgggacgggaacggaaccgtaacgttcggaccgttacgtaacgtcaacggacccgacggccctcccggcccgtcg

SEQ ID NO: 323553 - DNA, 567 bp, Homo sapiens
  misc_feature: GZ8MTXP01BYC7T.4.39.D06.1.454.CMB.2.raw
  modified_base (229)..(229): a, c, t, g, unknown or other
  misc_feature (229)..(229): n is a, c, g, or t
  modified_base (298)..(298): a, c, t, g, unknown or other
  misc_feature (298)..(298): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccngcagtgacgttggtcttatactatgtctctgaccaacaacaccagacaaacgccccaaatcataattangagtcataagcgccctcgacgggtccctgactcgtcttcctctcgccctaccgaggtctagggccaaaccgaccggcccttcccgtcgacccgtctcgtcgggctccgaggctaggagatgagtctagattatagtgctagtctnattangcgaggtactaagttacaagttgtgtaagttcgttcggggacggaacggaaaccctaagttccgttaccgttaccgtaagggtccaacggtcccgaagcccgtccgaacccccgttcgg

SEQ ID NO: 323554 - DNA, 582 bp, Homo sapiens
  misc_feature: GZ8MTXP01DFT98.4.39.D06.1.454.CMB.2.raw
  modified_base (304)..(304): a, c, t, g, unknown or other
  misc_feature (304)..(304): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttaataactatgtctctgaccaacaacaccaggacaaacgccccaaattcaataattangagtcactaagcgccctcgacgggtcctgactcgcttcctctcgccctacgaaggctggccaaaccgaccggtccctcccgtcgacccgtctccgtcgggctccgaggctggaggatggagtctagtattattattgactagtctacatatgcaggactagttaactaagtgtgtaagttacggttcggggacgggaaacgggtaaacctaaacgttcggttaacccgttacgtaagggtaccaacggacccgaagggccctcccggcccccgttcgg

SEQ ID NO: 323555 - DNA, 561 bp, Homo sapiens
  misc_feature: GZ8MTXP01DZI4S.4.39.D06.1.454.CMB.2.raw
  modified_base (228)..(228): a, c, t, g, unknown or other
  misc_feature (228)..(228): n is a, c, g, or t
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
tcagagcactgtagcacgaccggtgctcgatttagtgacatctcgcagttcgtttggggggtctcaggaggcagcgctctcaggacgtcaccaccatggcctgggctctgctcctcctcaccctctcactcagggcacagggtcctgggcccagtctgccctgactcagccctccctccgcgtccgggtctcctggacagtcagtcaccatctcctgcactggaaccngcagtgacgttggtcttaataactatgtctctgaccaacaacaccagcaaacgccccaaatcataattangagtcatagcgccctgacgggtcctgatcgcttcnctgcctccaaggctggcaacaccggccctccctgaccgtctctgggctccgaggctgaggatggaggctgtattattattgcagtctacgatatgcaggtactaagttacaaagttgtagtaattacgttcgggacgggttaacgggaaaccctaaacgttcgacccggttaccgttaagggtacctaacggaccccaagggttccctaaccggccccccgtttcggg

SEQ ID NO: 323556 - DNA, 550 bp, Homo sapiens
  misc_feature: GZ8MTXP01ELA18.4.39.D06.1.454.CMB.2.raw
  modified_base (323)..(323): a, c, t, g, unknown or other
  misc_feature (323)..(323): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgacgttggtcgttataactatgtctcctggtaccaacaacacccaggcaaagcccccaaattcataattatgagtcactaagcgccctnagggtcctgatcgcttctctgcctcaagctggcaacacggcctccctgacccgtctcgtgggctccgaggctgaggatgaggctgattattattgcagctcatatgcaggctagttacaatgtgaattagttcgggcgggttacgggaacctaaacgttcggttacccgttaccgtaagggttccgaacggacccccgaagggcccttccgcccccccgtttccggg

SEQ ID NO: 323557 - DNA, 513 bp, Homo sapiens
  misc_feature: GZ8MTXP01DLN24.4.39.D06.1.454.CMB.2.raw
  modified_base (295)..(295): a, c, t, g, unknown or other
  misc_feature (295)..(295): n is a, c, g, or t
  modified_base (355)..(355): a, c, t, g, unknown or other
  misc_feature (355)..(355): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaaccagcagtgacgttggtcgttataactatgtctctgaccaacacaccagcaaacgccccaaatcatattangagtcactaagcgcctcgaggggtcctgatcgcttcctctcgcctcaaggcctggcaacnccggccctcccgtgaccgtctcgtgggcctccgaggctgaggatggaggctagattattattgcagtctacatatgcaggctagttacaatgtgaattagttcggcggaggaaccaacgttcgaccgttctaaggtcaacgccaggctcgccccgtcg

SEQ ID NO: 323558 - DNA, 631 bp, Homo sapiens
  misc_feature: GZ8MTXP01CU8OH.4.39.D06.1.454.CMB.2.raw
  modified_base (255)..(255): a, c, t, g, unknown or other
  misc_feature (255)..(255): n is a, c, g, or t
  modified_base (301)..(301): a, c, t, g, unknown or other
  misc_feature (301)..(301): n is a, c, g, or t
  modified_base (328)..(328): a, c, t, g, unknown or other
  misc_feature (328)..(328): n is a, c, g, or t
  modified_base (411)..(411): a, c, t, g, unknown or other
  misc_feature (411)..(411): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccacatctcctgcactggaaccagcagtgacgttggtacttataactntgtctctgaccaacaacaccagacaaacgccccaaatcataattangagtcactagccgccctgacgggtccngatcgcttcctctcgcctccaaggctcggctaaaccgacccgggccctcccgtcgacccgttctccgtcgggtcctacccggnggtcgtaggaggagtggacggtctagttatttattagtcgacgtacgtctactaagtacgtcgacgtaggtactaagttaactaagttggttagtaacgttacgggttacggggacgggttaaacggtaaaccctaacggttaccggttacccggttaccgttaacgggtacccgaacggtaccccggacgggttcccttcccggttcccccgttaacgg

SEQ ID NO: 323559 - DNA, 525 bp, Homo sapiens
  misc_feature: GZ8MTXP01DNCRX.4.39.D06.1.454.CMB.2.raw
  modified_base (305)..(305): a, c, t, g, unknown or other
  misc_feature (305)..(305): n is a, c, g, or t
  modified_base (453)..(453): a, c, t, g, unknown or other
  misc_feature (453)..(453): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttaataactatgtctcctggtaccaacaacacccaggcaaacgccccaaattcataattangagtcactaagcgcctcgacggggtccctgatcgcttcctctgccctcaaggctggcaacacggccctccctgacccgtctctcgggctccgagctgaggatgagctgattagttattgctagctcatatgcaggcaagttacaatgngaattagttcgggcgagggaacctaaattcggacgttcgtaagtcaacgcccgaaggcctccgccccgtcgg

SEQ ID NO: 323560 - DNA, 572 bp, Homo sapiens
  misc_feature: GZ8MTXP01EQM9K.4.39.D06.1.454.CMB.2.raw
  modified_base (298)..(298): a, c, t, g, unknown or other
  misc_feature (298)..(298): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggaaccagcagtgacgttggtcttataactatgtctctgaccaacacaccagcaaacgccccaaatcatattangagtcactagcgccctgacgggtcctgatcgcttcctctcgcctcgaaggctggcaacgaccggccctccctgacccgtctcgtcgggctccgaggctgaggatggagctagattattagttgctagtcttacattatgaccgtaggacctaagtttaacaagttgtagtaattaacggttcgggacgggttaacgggaacctaaaacgttcgttacccgttaccgttaagggtccaacgacccgaacgggttcctcccggttccccgtccggg

SEQ ID NO: 323561 - DNA, 496 bp, Homo sapiens
  misc_feature: GZ8MTXP01DHLEY.4.39.D06.1.454.CMB.2.raw
  modified_base (376)..(376): a, c, t, g, unknown or other
  misc_feature (376)..(376): n is a, c, g, or t
  modified_base (459)..(459): a, c, t, g, unknown or other
  misc_feature (459)..(459): n is a, c, g, or t
tcagagcactgtagcacgaccggtgctcgatttagtgacatctcgcagttctttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggaaccagcagtgacgttggtcttataactatgtctcctggtaccaacaacacccaggacaaagcccccaaatcataattatgagtcataagcggccctcagggtccctgatcgcttcctctgctcaagctggcaaacacgcctccctgaccgtctcnggctccagctgagatgagctgattatattgcagctcatatgctaggcagttacaatgtgaatagttcggcgagggaccaaagngccgttcctaagtcaacgcccaaggctcgcccgtccg

SEQ ID NO: 323562 - DNA, 587 bp, Homo sapiens
  misc_feature: GZ8MTXP01BOQNL.4.39.D06.1.454.CMB.2.raw
  modified_base (229)..(229): a, c, t, g, unknown or other
  misc_feature (229)..(229): n is a, c, g, or t
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccngcagtgacgttggtcttatactatgtctctgacaacacaccagcaaanccccaatcatattangagtcactaagcgccctgacgggtccctgactcgctttccctctcgccctacaacggcctgggccaaaccgacccgggtccctcccctgtacccgtctcgtcgggcctcccgaggctggaggactggacgctagatttattagttcgactagtctacgattagcgacgaggtacctaagttacaaagttcgtagtaattacgttccggggacgggttacggggaaaccctaaacggttcggacccgttaccgaaggttacgaacgacccgaggttccctcggttcccccgtcggg

SEQ ID NO: 323563 - DNA, 599 bp, Homo sapiens
  misc_feature: GZ8MTXP01B27C6.4.39.D06.1.454.CMB.2.raw
  modified_base (231)..(231): a, c, t, g, unknown or other
  misc_feature (231)..(231): n is a, c, g, or t
  modified_base (261)..(261): a, c, t, g, unknown or other
  misc_feature (261)..(261): n is a, c, g, or t
tcagagcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagccctccctccgcgtccaggtctcctggacagtcagtcaccatctcctgcactggaaccngcagtgacgttgtcgtataactatgtctcnggtaccaacaacaccaggacaaacgaccccaaatcataatttatgagtacactagcggccctcgacgggtccctgactcgtccttctctcgccctccgaaacggctcggaccaaaccgaccgggtccctcccgtcgtaccgtctcgtgggcctcgaggctggaggcgtggacgtctagtatttattagttcgggactagtctacgtatagtcgacgtaggtacctaagttaactaagttggtaagtaagttaggttcggggacggtaaacgggtaaccaaacgttcggacccgttcgtacggtaacaccggccgaacggtcccttaaccgtcccccgg

SEQ ID NO: 323564 - DNA, 588 bp, Homo sapiens
  misc_feature: GZ8MTXP01CXSG9.4.39.D06.1.454.CMB.2.raw
  modified_base (229)..(229): a, c, t, g, unknown or other
  misc_feature (229)..(229): n is a, c, g, or t
  modified_base (281)..(281): a, c, t, g, unknown or other
  misc_feature (281)..(281): n is a, c, g, or t
  modified_base (297)..(297): a, c, t, g, unknown or other
  misc_feature (297)..(297): n is a, c, g, or t
  modified_base (381)..(381): a, c, t, g, unknown or other
  misc_feature (381)..(381): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccngcagtgacgttggtacttataactatgtctctgaccaacacaccagcaaacnccccaaatcatattangagtcactaagcgccctcgacgggtccctgactcgtcttcctctcgcctccgaaggccttggcctaaacgaccggtccctcccncgacccgtctccgtgggcctccgaggctaggaggatggaggcttagtattacttattgcagtcttacattatcgacgaggtactaagttaacgaattggtgtaagttacgttcggggacgggttaacgggaaaccctaaacgttcggacccgttccgtaagggtcctaacggaccccggaaggttcccttccggttcccccgttcgg

SEQ ID NO: 323565 - DNA, 536 bp, Homo sapiens
  misc_feature: GZ8MTXP01CNQ36.4.39.D06.1.454.CMB.2.raw
  modified_base (227)..(227): a, c, t, g, unknown or other
  misc_feature (227)..(227): n is a, c, g, or t
  modified_base (294)..(294): a, c, t, g, unknown or other
  misc_feature (294)..(294): n is a, c, g, or t
  modified_base (361)..(361): a, c, t, g, unknown or other
  misc_feature (361)..(361): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtcttatactatgtctctgaccaacacaccagcaaacgccccaaatcataattangagtcactaagcgccctgacgggtcctgatcgcttcctctgcctcaaggctggcaacgacgcctccngacctctctggctccaggctgagagtgagtctgattatattgacngtntcatatgcgaggtactagttaacaagttgtgtaagttacgttcgggacgggagggtaaaccctaaacgttcggacccgttccgtaagggtaccaacggaccccgaaggccctccgcccccgttcggg

SEQ ID NO: 323566 - DNA, 531 bp, Homo sapiens
  misc_feature: GZ8MTXP01ALP9O.4.39.D06.1.454.CMB.2.raw
  modified_base (226)..(226): a, c, t, g, unknown or other
  misc_feature (226)..(226): n is a, c, g, or t
  modified_base (294)..(294): a, c, t, g, unknown or other
  misc_feature (294)..(294): n is a, c, g, or t
  modified_base (431)..(431): a, c, t, g, unknown or other
  misc_feature (431)..(431): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcactggaaccngcagtgacgttggtcttatactatgtctctgaccaacaacaccagacaaagccccaaatcataattangagtcactaagccgccctcgacgggtccctgactcgcttcctctgcctccaaggctacggcaacgaccggtcctccccgtgaccgtctcgtcgggctcgaggctgagtatgagctagtattattattgcagctcatntgcgagctagtacattgtgtaatgttcgggacggaggaacctaaacgttcggaccgttcgtaaggtcaacgtcccgaaggttcctccgttccccgttcgg

SEQ ID NO: 323567 - DNA, 534 bp, Homo sapiens
  misc_feature: GZ8MTXP01C1W2E.4.39.D06.1.454.CMB.2.raw
  modified_base (228)..(228): a, c, t, g, unknown or other
  misc_feature (228)..(228): n is a, c, g, or t
  modified_base (378)..(378): a, c, t, g, unknown or other
  misc_feature (378)..(378): n is a, c, g, or t
  modified_base (426)..(426): a, c, t, g, unknown or other
  misc_feature (426)..(426): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccngcagtgacgttggtcttataactatgtctcctggtaccaacaacacccaggcaaacgcccccaaattcataatttatgaggtcactaagcggccctgacggggtccctgactcgcttcctctgcctcaaggctgggcaacacggcctccngacctctctgggctccagctgaggatgagctgattatattgcagtctnatatgcaggcagttacaatgtgaatagttcgggacggagggaaaccaacgttcgacccggttctaacgggtcaacggcccaaaggttcctaaccgcccccgttccggg

SEQ ID NO: 323568 - DNA, 606 bp, Homo sapiens
  misc_feature: GZ8MTXP01EHI20.4.39.D06.1.454.CMB.2.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctctcactcaggcacagggtcctgggcccagtctgccctgactcagccctccctccgcgtccgggtctcctggacagtcagtcaccatctcctgcactggaaccngcagtgacgttggtcttataactatgtctctgaccaacaacacccaggacaaacgcccccaaattcaataattangagtcataagcgccctgacgggtcctgatcgctttccnctcgcctcaaggcctaggcaacgaccggccctcccgtgacccgtctcgtgggcctccgaggctgaggatgagtctgtattatattgcagtctacgattagcgacgaggacttaagttaactaagttggtgtaaagtttcggttacggggacgggttaaacgggtaaaccctaaaacggttccggttaccccgttaccggttaacgggtaccaaccgggaccccgtaacgggttccccgttcccggttcccccccgtttaaccggg

SEQ ID NO: 323569 - DNA, 566 bp, Homo sapiens
  misc_feature: GZ8MTXP01AVQ1V.4.39.D06.1.454.CMB.2.raw
  modified_base (229)..(229): a, c, t, g, unknown or other
  misc_feature (229)..(229): n is a, c, g, or t
  modified_base (299)..(299): a, c, t, g, unknown or other
  misc_feature (299)..(299): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccngcagtgacgttggtcttataactatgtctctgaccaacaacaccagacaaacgccccaaatcataattangagtcatagcgccctcgacgggtcctgatcgcttcctctgcctccaaggctcggcaacgaccggccctcccgtgaccgtctcgtcgggctccgaggctggaggactggaggtctagtatttattagtgacagtctacattatgctaggtactaagtttaacaaagttggtagtaattaggttcggggaacgggttaacgggaaacctaaacgttcgacccgttacgtaaggtccaacggccccgaggttccctccggcccccgtcgg

SEQ ID NO: 323570 - DNA, 685 bp, Homo sapiens
  misc_feature: GZ8MTXP01ACPDI.4.39.D06.1.454.CMB.2.raw
  modified_base (226)..(226): a, c, t, g, unknown or other
  misc_feature (226)..(226): n is a, c, g, or t
  modified_base (297)..(297): a, c, t, g, unknown or other
  misc_feature (297)..(297): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcactggaaccngcagtgacgttggtcgttataactatgtctctggaccaacacaccagcaaacgccccaaatcataatttangagtcactaagcggccctcgacggggtccctgatcgcttcctctcgccctaccgaaggccttacgggcctaaaccgaaccgggtccctacccccgtacggtacccgtccttccgttcgggggcccttacccgaaggggccttagggaacgggtaagttcgggaaacgggtccgttaggttaaacttttaaagtttaagtttcgggacctaaggtcctttaccaacgtttaagtcggaccgtaagggtacctaaaggttttaacaaagttggttagaactttaaggttccggggacgggaacggggtaaaccctaaaacggttcggttaccccggttaccgtaagggtccaacggaccccgaacgggccttcccggccccccgttcggg

SEQ ID NO: 323571 - DNA, 586 bp, Homo sapiens
  misc_feature: GZ8MTXP01BV57O.4.39.D06.1.454.CMB.2.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcgttataactatgtctcctggtaccaacaacacccagcaaacgccccaaattcataattangagtcactagcgccctcgagggtccctgactcgcttcctctgcctccaaggctggccaacaccgggcctccccgtcgacccgtctcgtcgggcctccgaggcctaggaggatggaggctagtattattattgctagtctcatatgacgaggtctagttacgaattgtagtaagttacgttcggggacgggacgggtaaaccctaacggttcggacccgttaccggaaggttcccgaacggacccgtaacgggttcccgtaacccggttcccccgtttccggg

SEQ ID NO: 323572 - DNA, 547 bp, Homo sapiens
  misc_feature: GZ8MTXP01EY9L8.4.39.D06.1.454.CMB.2.raw
  modified_base (228)..(228): a, c, t, g, unknown or other
  misc_feature (228)..(228): n is a, c, g, or t
  modified_base (481)..(481): a, c, t, g, unknown or other
  misc_feature (481)..(481): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcgttataactatgtctcctggaccaacaacacccaggcaaacgccccaaatcataatttatgaggtcactaagcggccctcgacggggtccctgatcgcttcctctgcctcaagctggcacacggcctccctgaccgtctctgggctccgaggctggaggtactggaggctagattaatttagttgcgagtctacatactggcaggtccaagttacaatggtagtaatagtttccgggngggttaacggaacctaaacgttcgaccgttcgttaagcaacgcccaaggccctcgcccccgttcgg

SEQ ID NO: 323573 - DNA, 627 bp, Homo sapiens
  misc_feature: GZ8MTXP01BY9P6.4.39.D06.1.454.CMB.2.raw
  modified_base (297)..(297): a, c, t, g, unknown or other
  misc_feature (297)..(297): n is a, c, g, or t
  modified_base (357)..(357): a, c, t, g, unknown or other
  misc_feature (357)..(357): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtacttataactatgtctctgaccaacacaccagacaaacgccccaatcatattangagtcactaagcggccctcgacgggtcctgactcgcttcctctgcctccaggctgcaacnccggccctccctgaccgtctcgtcgggctccgaggtctaggaggagttggaggtctagtatttattattgcgtagtccttacattagtgaccgaggtaccgttagttaaaccgtaagttcggtaggtaacgtttacggtttcggggtaaccggggttaacggtaaaccccgtaaacgttacccgggttaccccggttaccggttaaccgggtacaacccgggtaccccgaacgggttccccgttaaccccggttcccccgttaacccggg

SEQ ID NO: 323574 - DNA, 584 bp, Homo sapiens
  misc_feature: GZ8MTXP01CITO7.4.39.D06.1.454.CMB.2.raw
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (295)..(295): a, c, t, g, unknown or other
  misc_feature (295)..(295): n is a, c, g, or t
  modified_base (461)..(461): a, c, t, g, unknown or other
  misc_feature (461)..(461): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttatactatgtctctgacaacacaccagacaaacnccccaatcataattangagtcactagccgccctgacgggtccctgactcgcttcctctcgccctccgaaggccttcgggccaaaccgacccgggtccctccccgtacgacccgtctccgtcgggcctccgaggctaggaggatggaggtctagtatttagttattgctagtctacattacgngacgtaggtactaagttaactagtgtagtaagttacggttcgggacggaaacggaaacctaacgttaccgttccgttacgtaaggacgaaccgacccgacggttcccgtcccgttccccgtcg

SEQ ID NO: 323575 - DNA, 560 bp, Homo sapiens
  misc_feature: GZ8MTXP01BL07M.4.39.D06.1.454.CMB.2.raw
  modified_base (430)..(430): a, c, t, g, unknown or other
  misc_feature (430)..(430): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttatactatgtctctggaccaacaacaccagcaaacgccccaaatcataattatgagtcactagcgccctcgacgggtccctgatcgcttcctctgcctcaggctggcaacgaccggccctcccgtgacccgtctcgtcgggcctccgaggctaggaggatggaggtctgattattattgcagtctnatatgcaggctagttacaagttgtagaattagttcgggacgggttaacggaaccctaaacgttcggttacccggttccgtaaggggtccaacggccccgaaggttcccgtcccggttcccccgttccggg

SEQ ID NO: 323576 - DNA, 547 bp, Homo sapiens
  misc_feature: GZ8MTXP01AJEJK.4.39.D06.1.454.CMB.2.raw
  modified_base (303)..(303): a, c, t, g, unknown or other
  misc_feature (303)..(303): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactatgtctcctggaccaacaacacccaggacaaacgccccaaattcataattangagtcactaagccggccctcgacggggtccctgactcgtcttcctctgcctccaaggctggcaacaccgggcctccctgaccgtctcgtcgggctccgaggtctaggagagtgaggatgtatttattattgcagtctcatatgcaggctaagttacaaagttgtgtaattacgttcgggacgggttaacgggaaccaaacgttcgacccgttctaagggtcaacgccgagcctcgccccgtcgg

SEQ ID NO: 323577 - DNA, 567 bp, Homo sapiens
  misc_feature: GZ8MTXP01E0403.4.39.D06.1.454.CMB.2.raw
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
  modified_base (343)..(343): a, c, t, g, unknown or other
  misc_feature (343)..(343): n is a, c, g, or t
  modified_base (450)..(450): a, c, t, g, unknown or other
  misc_feature (450)..(450): n is a, c, g, or t
  modified_base (468)..(468): a, c, t, g, unknown or other
  misc_feature (468)..(468): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctcgcgtccggtctcctggacagtcagtcaccatctcctgcactgaaccngcagtgacgttggtacttataactatgtctctgaccaacaacaccagacaaacgccccaaattcataatttangagtcactaagccgccctcgacggggtccctgactcgcttccnctgcctccaagctggcaacaccggccctccctgaccgtctcgtcgggcctccgaggctggagtagtggaaggtctagtaatttagttattcgactagtctacattangccgaggactaagttaanaagtgtagaattacgttcggggacggaacggaacctaaacgttcgacccgttccgtaagggcaacggccctaagggccctcccggttcccccgttccgg

SEQ ID NO: 323578 - DNA, 644 bp, Homo sapiens
  misc_feature: GZ8MTXP01C9THA.4.39.D06.1.454.CMB.2.raw
  modified_base (230)..(230): a, c, t, g, unknown or other
  misc_feature (230)..(230): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctctgcactggaaccngcagtgacgttggtcttataactatgtctctgaccaacacaccagcaaacgccccaaatcataattatgagtcactaagcgccctcgacgggtccctgactcgtcttcctctgccctcaggctggcaacaccggccctcccgtcgaccgtctcgtcgggctccgaggcctggaggactggaggtctaggtatttatttaattcgacgtagtccttacaagttagtcgccgagggtacctaagttaacgtaaagttggttaggtaaactttaacgggttaccggggaccggggttaaacggggtaaacccctaaaacgttcccgggttaaacccggttacccgttaaggggtacccaaccgggtacccccgtaaacgggccccgtttaaccccgggccccccccgtttaaccggg

SEQ ID NO: 323579 - DNA, 581 bp, Homo sapiens
  misc_feature: GZ8MTXP01BD2LU.4.39.D06.1.454.CMB.2.raw
  modified_base (226)..(226): a, c, t, g, unknown or other
  misc_feature (226)..(226): n is a, c, g, or t
  modified_base (276)..(276): a, c, t, g, unknown or other
  misc_feature (276)..(276): n is a, c, g, or t
  modified_base (291)..(291): a, c, t, g, unknown or other
  misc_feature (291)..(291): n is a, c, g, or t
  modified_base (330)..(330): a, c, t, g, unknown or other
  misc_feature (330)..(330): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcacatctctgcactggaaccngcagtgacgttggtcttatactatgtctctgaccaacacaccagcaaacnccccaatcatattangagtcactaagcgccctgacgggtcctgactcgcttccnctgcctcagctgcaacaccggccctcccgtgaccgtctcgtcggctccgaggctggaggagtggagtctagtattattattgctagtctacagtatcgcgtaggtacctaagttaactaaagttggtagtaagttacggttccggggaacgggaaacggggtaaaccctaaacggttcggttaacccggttaccgtaaggtacccgaacgtaccccggaaggttcccgtcccggttcccccgttaaccggg

SEQ ID NO: 323580 - DNA, 566 bp, Homo sapiens
  misc_feature: GZ8MTXP01AISNL.4.39.D06.1.454.CMB.2.raw
  modified_base (301)..(301): a, c, t, g, unknown or other
  misc_feature (301)..(301): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctggaccaacaacacccaggcaaacgccccaaattcataattangagtcactaagcgccctcgacggggtccctgactcgcttcctctgcctcaaggctgggcaacaccggcctccctgaccgtctcgtcgggctccaggctggacggatggaggtctaggaactttattaattgctagcttacatatgcaggtactagttacaaagttgtgtaatagttcgggacggaggggtaaaccctaaaacgttcggttaccgttaccgtaagggtcaacggaccccgaagggttccctaacgcccccgttcgg

SEQ ID NO: 323581 - DNA, 580 bp, Homo sapiens
  misc_feature: GZ8MTXP01EELEQ.4.39.D06.1.454.CMB.2.raw
  modified_base (300)..(300): a, c, t, g, unknown or other
  misc_feature (300)..(300): n is a, c, g, or t
  modified_base (418)..(418): a, c, t, g, unknown or other
  misc_feature (418)..(418): n is a, c, g, or t
  modified_base (430)..(430): a, c, t, g, unknown or other
  misc_feature (430)..(430): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactggaaccagcagtgacgttggtcgttaataactatgtctcctggtaccaacaacaccagcaaacgccccaaatcataattngagtcactagcgccctgagggtccctgatcgcttcctctgcctcaaggctagggcaaacaccgggtccctcccgtcgaccgtctcgtcgggctccgaggctggagatgaggctgattntacttgcagctntaatatgcaggactagttacaagttgtagaagttacgttacggggcggaaagggtaaaccctaaaagttcgggacccgttacccgtaaagggttcccgaacgggtccccgtaaagggcccgttaacccggttccccccgttaacccgggg

SEQ ID NO: 323582 - DNA, 637 bp, Homo sapiens
  misc_feature: GZ8MTXP01A62WE.4.39.D06.1.454.CMB.2.raw
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (376)..(376): a, c, t, g, unknown or other
  misc_feature (376)..(376): n is a, c, g, or t
tcagagcactgtagcacgaccggtgctcgatttagtgacatctcgcagttctttgggttttggggggaagtgtggtacggcctggggggtccctgagactctcctgtacagcctctggattctcctttgatgattatggcatgagctgggtccgccaagctccgaggggaagggctggagtgggtgtctggtatgaattggagtggcggtagtacagcttangcagactntgtgaaggccattcaccatctccagagacaacgcaaagactcctgtatctgacaattgaacagtctgagagccgagacacggtcctttagtattacgtgtcgacgaagtaaactagtttagggggtgtagtagtaggtaaaaaccngtctgtacttagttcggtcgtacggtttgggttacgacgtacggtcggggcgagggtacgtcccgtcggtcctaccgtcctcctcgacgtcccgtacccgaaccggggaaccgggtcccctacgttcccggttccccgttcccccggcgcccgtcccgtcgtcccgtacggacggccgcccgaccgcgacgacgaccgaccgcggcccggcccggtcggccgtcggtccggtcggttaccgtaaccgttaaccttaacccg

SEQ ID NO: 323583 - DNA, 589 bp, Homo sapiens
  misc_feature: GZ8MTXP01DVANH.4.39.D06.1.454.CMB.2.raw
  modified_base (231)..(231): a, c, t, g, unknown or other
  misc_feature (231)..(231): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (470)..(470): a, c, t, g, unknown or other
  misc_feature (470)..(470): n is a, c, g, or t
tcagagcactgtagcacgaccggtgctcgatttagtgacatctcgcagttcgtttgggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccngcagtgacgttggtcttaatactatgtctctgaaccaacacaccagacaaacnccccaaatcataattangagtacactaagcgtccctcgacgggtcctgactcgtcttcctctgcctacgaagctgcaacaccggcctccctgaccgtctcgtggctccgaggctaggagtatggaggtctagtaatttagttattgcgatcttcaatatcgcgaaggtactagtttaacaagttgngtaattcggttaccggggacgggttaaacggggaaaccctaaacggttcggacccgttaccgttaacggggaccaacggaccccgaacggttcccttaacccgttccccccggtttaag

SEQ ID NO: 323584 - DNA, 599 bp, Homo sapiens
  misc_feature: GZ8MTXP01EX5F3.4.39.D06.1.454.CMB.2.raw
  modified_base (307)..(307): a, c, t, g, unknown or other
  misc_feature (307)..(307): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgtacgttggtcttaataactatgtctcctggtaccaacaacaccaggacaaacgccccaaattcataattangagtcaactaagcgccctcgacgggtcctgatcgctttcctctcgccctacaaggcctggccaaacgaccggccctccctcgacccgtctcgtcgggcctccgaggctggaggtactggagctagtatttattatgcgtaagtcctanagtntcgcgaaggtcctaagttaacagtgtagaattacggttcgggacggttaacgggaaaccctaaacggttcgttacccgttaccgttaacggccaaccggtaccccgaaggttcccgtaacccgttcccccggttaaccgg

SEQ ID NO: 323585 - DNA, 574 bp, Homo sapiens
  misc_feature: GZ8MTXP01CZ8J4.4.39.D06.1.454.CMB.2.raw
  modified_base (226)..(226): a, c, t, g, unknown or other
  misc_feature (226)..(226): n is a, c, g, or t
  modified_base (292)..(292): a, c, t, g, unknown or other
  misc_feature (292)..(292): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtccacatctctgcactggaaccngcagtgacgttggtcttataactatgtctctgaccaacaacaccagcaaagccccaatcatattangagtcactaagcgccctcgacgggtccctgatcgtcttcctctgcctcgaaggctggccaacaccggccctcccgcgaccgtctcgtcgggcctccgaggctggacggatcggaggctagattattaagttgctagctacattatgcgaggactaagttactaaattggtgtaagttaggttcgggacggggaacgggtaaaccctaaacgttcggttacccgttaccggttaaggaccaacggtaccccgaagggttcccttaaccggccccccgtttcgg

SEQ ID NO: 323586 - DNA, 552 bp, Homo sapiens
  misc_feature: GZ8MTXP01DGPTG.4.39.D06.1.454.CMB.2.raw
  modified_base (299)..(299): a, c, t, g, unknown or other
  misc_feature (299)..(299): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcacatctctgcactggaaccagcagtgacgttggtcttataactatgtctctggaccaacaacaccaggcaaacgccccaaattcataatttangagtcactaagcgccctgagggtccctgactcgcttcctctgccctcgaaggctggcaaacaccggccctaccctgacccgtctcgtcgggctccgaggctgaggatggagctgattattattgcagctcatatgcaggactagttaacatgtagtaataagttcgggacggaacgggtaacctaaaacgttcgttacccgttaccgtaaggtaccgaacgacccgaaacgggttcctccgcccccgttccgg

SEQ ID NO: 323587 - DNA, 589 bp, Homo sapiens
  misc_feature: GZ8MTXP01AEPE5.4.39.D06.1.454.CMB.2.raw
  modified_base (230)..(230): a, c, t, g, unknown or other
  misc_feature (230)..(230): n is a, c, g, or t
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (340)..(340): a, c, t, g, unknown or other
  misc_feature (340)..(340): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcaggtgacgttggtcttataactatgtctctgaccaanacaccagcaaacgccccaaatcatattangagtcactaagcggccctcgaggggtccctgactcgcttccnctgcctcaagctggcaacaccggcctccctgacccgtctcgtcgggcctcgaggctaggaggactggaggtctagtatttattattgctagtctcgaattagtgcgtagggacctagttaacaagttggtagtaagttaggttccggggacggggaaacgggtaaacccgaaacgttcggacccgttacccgtaagggtaccaaccggtccccggaaacggttcccgtccgttcccccccggtttccgg

SEQ ID NO: 323588 - DNA, 516 bp, Homo sapiens
  misc_feature: GZ8MTXP01AIO6Y.4.39.D06.1.454.CMB.2.raw
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (365)..(365): a, c, t, g, unknown or other
  misc_feature (365)..(365): n is a, c, g, or t
  modified_base (448)..(448): a, c, t, g, unknown or other
  misc_feature (448)..(448): n is a, c, g, or t
  modified_base (492)..(492): a, c, t, g, unknown or other
  misc_feature (492)..(492): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactatgtctcctgaccaacaacacccaggacaaacgccccaaattcatattangagtnactagcgcctgagggtcctgatcgcttcctctgcctccaagctggcaacacggccctccngacctctcgtcgggctccgaggctggacggtatgaggtctagtattattattggcagctcatatgcaggctagttacatggtnaatagttcgggcggagggaacccaaacgttgccgttctaacggnaacgccctaggctcgccccgttcg

SEQ ID NO: 323589 - DNA, 546 bp, Homo sapiens
  misc_feature: GZ8MTXP01ANRW6.4.39.D06.1.454.CMB.2.raw
  modified_base (303)..(303): a, c, t, g, unknown or other
  misc_feature (303)..(303): n is a, c, g, or t
  modified_base (330)..(330): a, c, t, g, unknown or other
  misc_feature (330)..(330): n is a, c, g, or t
  modified_base (445)..(445): a, c, t, g, unknown or other
  misc_feature (445)..(445): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggaccaacaacaccagacaaacgccccaaattcataatttangagtcactaagcgccctgacgggtccngatcgcttcctctgcctccgaaggctggccaacgccggccctccctcgaccgtctcgtcgggcctccgaggctgacggatggagtctagtatttatattgctagcttacgattgngcgaggtctagttacaagtgtgaattaggttcggacggttacgggaacctaacgttcgacccgttcgtaaggtcaacgcccagggccctccgcccccgtcg

SEQ ID NO: 323590 - DNA, 537 bp, Homo sapiens
  misc_feature: GZ8MTXP01DV2EE.4.39.D06.1.454.CMB.2.raw
  modified_base (303)..(303): a, c, t, g, unknown or other
  misc_feature (303)..(303): n is a, c, g, or t
  modified_base (438)..(438): a, c, t, g, unknown or other
  misc_feature (438)..(438): n is a, c, g, or t
tcagagcactgtagcacgaccggtgctcgatttagtgacatctcgcagttcgtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaaccagcagtgacgttggtcttaataactatgtctcctggaccaacaaccaccagacaaacgccccaaatcataattangagtcactagcgccctcgagggtcctgatcgcttcctctcgcctccaaggctcggcaacaccggccctcccgtcgacccgtctcgtcgggcctccgaggctaggacgagtgagtctagatttatattgcagtctnatatgcaggactagttacagtgtgaattcgttcggacggaggtaaaccaagttcgaccgttacgtaaggtcaacgcccgaaggcctccgccccgttcgg

SEQ ID NO: 323591 - DNA, 526 bp, Homo sapiens
  misc_feature: GZ8MTXP01D0OOB.4.39.D06.1.454.CMB.2.raw
  modified_base (226)..(226): a, c, t, g, unknown or other
  misc_feature (226)..(226): n is a, c, g, or t
  modified_base (276)..(276): a, c, t, g, unknown or other
  misc_feature (276)..(276): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctcctccgcgtccggtctcctggacagtcagtcacatctctgcactggaaccngcagtgacgttggtcttaatactatgtctctgacaacacaccagcaaacnccccaatcataattatgagtacatacgcgccctcgacgggtcctgatcgcttcctctcgcctccaagctggcaacaccggccctccctgaccgtctcgtcgggctcgagctgagatgagctagattattattgcagtctcatagtgacgaggactagttaataagttgtgaattagttcgggacggttaagggaacctaaacgttcggccgttacgtaacggcaacgtaccgaggcctccgccccgttcg

SEQ ID NO: 323592 - DNA, 606 bp, Homo sapiens
  misc_feature: GZ8MTXP01B1VYZ.4.39.D06.1.454.CMB.2.raw
  modified_base (231)..(231): a, c, t, g, unknown or other
  misc_feature (231)..(231): n is a, c, g, or t
  modified_base (307)..(307): a, c, t, g, unknown or other
  misc_feature (307)..(307): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
  modified_base (403)..(403): a, c, t, g, unknown or other
  misc_feature (403)..(403): n is a, c, g, or t
  modified_base (449)..(449): a, c, t, g, unknown or other
  misc_feature (449)..(449): n is a, c, g, or t
tcagagcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgtacgttggtacttaataactatgtctctagaccaacaacaccagacaaacgaccccaaatcaataattangagtcaactagccgcctgacgggtccngactcgtcttccnctcgcctaccgaggcctcgcaaacgccgtccctcctgaccctctcgtcggctccgnggctggagacgtggagtctgtaatttagttattgacgtagtccttnaattatgcgtacggactaagttactaagttgtgtaattacggttacggggacggaacgggtaaacctaaccggttccggttaccggttacccgtaagggtacccgaaccggtaccccggaaagggttccccgttccccgggttccccccgtttccgg

SEQ ID NO: 323593 - DNA, 657 bp, Homo sapiens
  misc_feature: GZ8MTXP01E2C52.4.39.D06.1.454.CMB.2.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
tcagagcactgtagcacgaccggtgctcgatttagtgacatctcgcagttcgtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctctgcactggaaccngcagtgacgttggtcttatactatgtctctagacaacaacaccagacaaacgacccctaaatcaataatttanagaggtacaacgtaacgcggccctacgacggggtccctgactcgcttcctctcgcctacgaacggctacgggaaccaaaccgccgggtccctccccgtacggtaacccgtcttcgtcggggtcctacccgagggctaggaagggtagtgggaacgggtctagtaattttattacgttcggactaacggtccttaacgtaatttaagtcggacctaaagggggtacctaaagggtttttaaaccaaagttggttacgtaagtttaacggttacggggacgggttaaacgggaacctaaacgttcgaaccggttccgtaaggccgaacgacccgaggttccctcccggccccgttcg

SEQ ID NO: 323594 - DNA, 589 bp, Homo sapiens
  misc_feature: GZ8MTXP01AGFWQ.4.39.D06.1.454.CMB.2.raw
  modified_base (298)..(298): a, c, t, g, unknown or other
  misc_feature (298)..(298): n is a, c, g, or t
  modified_base (325)..(325): a, c, t, g, unknown or other
  misc_feature (325)..(325): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggaaccagcagtgacgttggtcttatactatgtctctgaccaacaacaccagacaaacgccccaaattcataattangagtcactagcgcctcgacgggtcccngatcgtcttcctctgccctaccgaaggtcctcggccaacgacccgggtccctccccgtcggacccgttctccgtcgggcctccgaggcgtaggaggagtggaggtctagtatttattattgactagtcttacgatagtcgcgaggtactaagttaacaagttgtagtaagtaacgttcggggacggttaacgggaaacctaaacgttcggacccgttcgtaacgggtcaacggacccgtacgggccctccgttccccgtaacgg

SEQ ID NO: 323595 - DNA, 502 bp, Homo sapiens
  misc_feature: GZ8MTXP01A22NT.4.39.D06.1.454.CMB.2.raw
  modified_base (293)..(293): a, c, t, g, unknown or other
  misc_feature (293)..(293): n is a, c, g, or t
  modified_base (332)..(332): a, c, t, g, unknown or other
  misc_feature (332)..(332): n is a, c, g, or t
  modified_base (349)..(349): a, c, t, g, unknown or other
  misc_feature (349)..(349): n is a, c, g, or t
  modified_base (365)..(365): a, c, t, g, unknown or other
  misc_feature (365)..(365): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttatactatgtctctgaccaacacaccagcaaacgccccaaatcataattangagtcactaagcggccctcgacgggtcctgattgcttcnctgcctcagctggcacncgcctcctgactctcnggctcgagctgagatgagctgattatatgnagctcattangcaggcagttacaattgtgaattacgttcgggacggttaggaaccaaacgttcgaccgttctaaggtcaacggcccaaggcctaacgttccccgtcg

SEQ ID NO: 323596 - DNA, 594 bp, Homo sapiens
  misc_feature: GZ8MTXP01EN3GH.4.39.D06.1.454.CMB.2.raw
  modified_base (228)..(228): a, c, t, g, unknown or other
  misc_feature (228)..(228): n is a, c, g, or t
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgtacgttggtacttaataactatgtctctagaccaacaacaccagacaaacnccccaaatcaataattangagtcaatagcgccctgacgggtcctgactcgtcttcctctcgcctacgaaggctaggccaacgaccggtccctcccgtcgacccgtctcgtcggctaccgaggcgtagaggtagtggaggtctagtatttattagttcgcgtagtctactaatagtcgacgtaggactaagtaactaagtgtagtaaacgttggttacgggacgggaacggtaaacctaaacgttcggttacccgttacgtaacggtcgaaccgacccgtacggttccgttaacccgttccccgttccgg

SEQ ID NO: 323597 - DNA, 613 bp, Homo sapiens
  misc_feature: GZ8MTXP01AQSQU.4.39.D06.1.454.CMB.2.raw
  modified_base (229)..(229): a, c, t, g, unknown or other
  misc_feature (229)..(229): n is a, c, g, or t
  modified_base (299)..(299): a, c, t, g, unknown or other
  misc_feature (299)..(299): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatcctctgcactggaaccngcagtgacgttggtcttatactatgtctctgaccaacaacaccagacaaacgccccaaattcataattangagtcactagcgccctcgacgggtcctgatcgcttcctctcgccctaccgaaggtcgtacggccaaaccgaccgggcccttccccgtgacccgttctccgtcgggtcctccggacggtctaggaacggtatggaggtcttagtaactttagttagttcgacgtaggtccttactaattagtcgccgtagggacctaagttaacctaagttgtagtaattacggttcgggacgggttaacgggaaccctaaagttcggttccgttaccgtaaggtccaacggtacccgacggttcctaacccggccccgttccgg

SEQ ID NO: 323598 - DNA, 579 bp, Homo sapiens
  misc_feature: GZ8MTXP01CP5Q4.4.39.D06.1.454.CMB.2.raw
  modified_base (229)..(229): a, c, t, g, unknown or other
  misc_feature (229)..(229): n is a, c, g, or t
  modified_base (329)..(329): a, c, t, g, unknown or other
  misc_feature (329)..(329): n is a, c, g, or t
  modified_base (461)..(461): a, c, t, g, unknown or other
  misc_feature (461)..(461): n is a, c, g, or t
  modified_base (485)..(485): a, c, t, g, unknown or other
  misc_feature (485)..(485): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccngcagtgacgttggtcttataactatgtctctgaccaacaacaccagacaaacgccccaaattcaataattatgagtcataagcggccctcgagggtcccngactcgtcttccctctcgccctaccgaaggctcggcaaaccgaccggccctccctcgacccttctcgtcgggctcccgaggctaggaggaacgtggaaggtctagtaactttattagttgctagcttcattntgcaggtacctaagttacatggtnaagttcgttacgggcggttaacgggaacctaacgttacgcccgttaccgtaaggtcccaacggcccgaacggttcctcccggttccccgtccgg

SEQ ID NO: 323599 - DNA, 572 bp, Homo sapiens
  misc_feature: GZ8MTXP01AUZA6.4.39.D06.1.454.CMB.2.raw
  modified_base (294)..(294): a, c, t, g, unknown or other
  misc_feature (294)..(294): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttatactatgtctctgacaacacaccagacaaacgccccaatcatattangagtcactagcgccctcgacgggtccctgactcgtcttcctctgcctccaaggctcggcaacgccggccctcctgaccgtctcgtcgggctccgagctgaggatggagtctagtattattatgcagtctacatacgtgacgacggtactaaggttaacaagttggtagtaagttacggttccggggacgggaacgggtaaaccctaaacggttccggttacccgttcgtaacgggtccgaacggtaccccgaagggttcccgtcccgcccccgttccg

SEQ ID NO: 323600 - DNA, 559 bp, Homo sapiens
  misc_feature: GZ8MTXP01BO9DQ.4.39.D06.1.454.CMB.2.raw
  modified_base (228)..(228): a, c, t, g, unknown or other
  misc_feature (228)..(228): n is a, c, g, or t
  modified_base (301)..(301): a, c, t, g, unknown or other
  misc_feature (301)..(301): n is a, c, g, or t
  modified_base (380)..(380): a, c, t, g, unknown or other
  misc_feature (380)..(380): n is a, c, g, or t
  modified_base (429)..(429): a, c, t, g, unknown or other
  misc_feature (429)..(429): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccngcagtgacgttggtcttatactatgtctctgtaccaacaacaccagcaaacgcccccaaattcaataatttangagtcactaagcgccctgacgggtccctgatcgcttcctctgccctcaaggcctggcacgaccggcctccctgaccgtntcgtgggctccgaggctggagactggagtctgattattatgcgagtctnagtatgcgaggactagttacaagttcgtgtaattaacgttcgggacggacgggtaaacctaaacgttcggacccgttaccgtaagggtcaaccggcccgaagggttccgtccgttcccccgttaaccggg

SEQ ID NO: 323601 - DNA, 629 bp, Homo sapiens
  misc_feature: GZ8MTXP01E074S.4.39.D06.1.454.CMB.2.raw
  modified_base (324)..(324): a, c, t, g, unknown or other
  misc_feature (324)..(324): n is a, c, g, or t
  modified_base (372)..(372): a, c, t, g, unknown or other
  misc_feature (372)..(372): n is a, c, g, or t
  modified_base (439)..(439): a, c, t, g, unknown or other
  misc_feature (439)..(439): n is a, c, g, or t
tcagagcactgtagcacgaccggtgctcgatttagtgacatctcgcagttcgtttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtcaccatctcctgcactggaaccagcaggtgtacgttggtctttaataactatgtctccgtagtaaccaacaaccacccaggaccaaacgacccccaaattacaattaaatttangagtacaactaacgcggccctacgacgggtccctgactcgtcttcccnctcgccctacgaaggctacggccaaaccgccggtccctcccgtggacccgtctcgtgggcctaccgnggactggaggtatggagtctagtaattattattcgacgtagtctctaattaagtccgagtaacgggtactaagttaacagttagtcgtaaagttcgggttacggggaccgggttaacgggaaacctaaacgttcggttaacccgttcgaagtacaaccggtcccgaacgccgtaacccgttccccgtcgg

SEQ ID NO: 323602 - DNA, 646 bp, Homo sapiens
  misc_feature: GZ8MTXP01BW1LN.4.39.D06.1.454.CMB.2.raw
  modified_base (231)..(231): a, c, t, g, unknown or other
  misc_feature (231)..(231): n is a, c, g, or t
  modified_base (313)..(313): a, c, t, g, unknown or other
  misc_feature (313)..(313): n is a, c, g, or t
  modified_base (488)..(488): a, c, t, g, unknown or other
  misc_feature (488)..(488): n is a, c, g, or t
tcagagcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtacgttataactatgtctcctagaaccaacaaccaccaggacaaacgacccctaaattcaattaattanagagtacaataacgccgccctcgacgggtccctgactcgtcttcctctcgccctaccgaaggtcctacggcaaccgaccgggtccctcccgtcgacccgtctcgtcgggcctccgaggtctaggaggatggacggtcttagtatttagttattcgacgtacgtcttacattacgngaccgtaggtacctaagttaacctaagttgtagtaacgttacggttaccggggaacgggaacgggtaaaccctaaacgttccggacccgttaccgtaacgggtaccctaaccgggaacccgtaacgggttcccttccccgggttcccccgttaacggg

SEQ ID NO: 323603 - DNA, 568 bp, Homo sapiens
  misc_feature: GZ8MTXP01A6DLL.4.39.D06.1.454.CMB.2.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
  modified_base (385)..(385): a, c, t, g, unknown or other
  misc_feature (385)..(385): n is a, c, g, or t
  modified_base (429)..(429): a, c, t, g, unknown or other
  misc_feature (429)..(429): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccngcagtgacgttggtcttataactatgtctctggtaccaacaacaccaggacaaacgccccaaatcataactttangagtcactaagcggccctcgaggggtccctgatcgcttccnctgcctccaggctggcaaacacggcctcctgacctctcgnggctcaggctgagatgagctagacttaatattgcgtagtcctanatactgctacggactagttaacaaagttgagtaattaacggttcgggaccgggttaagggaaacctaaaaccgttcggacccgttaccgttaaggcaaccggacccgaacgggttcctccggttaacccccgttccggg

SEQ ID NO: 323604 - DNA, 578 bp, Homo sapiens
  misc_feature: GZ8MTXP01ESKVE.4.39.D06.1.454.CMB.2.raw
  modified_base (297)..(297): a, c, t, g, unknown or other
  misc_feature (297)..(297): n is a, c, g, or t
  modified_base (461)..(461): a, c, t, g, unknown or other
  misc_feature (461)..(461): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgacgttggtacttataactatgtctctgaccaacaacaccagacaaacgccccaatcatattngagtcactagcgccctgacgggtcctgactcgcttcctcgtcgccctaccgaaggcctagggccaaacgacccgggtcccctccccgtcggtacccgtctcgtcgggctccgaggtcgtgaggtactggaggtctgtattattattgctaggtctacattacgngcgagggacctaaggttactaaagttgtagtaagttacgttacgggacgggttaacggacctaaacgttcggttaccgttacgtaaggcaacgcccaggccctcccgccccgttcgg

SEQ ID NO: 323605 - DNA, 576 bp, Homo sapiens
  misc_feature: GZ8MTXP01AL8Y4.4.39.D06.1.454.CMB.2.raw
  modified_base (228)..(228): a, c, t, g, unknown or other
  misc_feature (228)..(228): n is a, c, g, or t
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtcttatactatgtctctgaccaacaacaccagacaaacnccccaaatcatattangagtcactagcgccctgacgggtcctgactcgcttcctctgccctacgaggctacggccaacgaccgggtccctcccgtgaccgtctcgtcgggcctccgaggtctggaggtatggagtcttagtatttagttagttcgacgtacgtcttacagttagtcgcgaggtacctaagttactaaagttgtagtaattacggttcgggacggttaacgggaaacctaaacgttcggacccgttacgtaaggtaccgaacgtacccgagccgtccgccccgttcg

SEQ ID NO: 323606 - DNA, 609 bp, Homo sapiens
  misc_feature: GZ8MTXP01D0PH4.4.39.D06.1.454.CMB.2.raw
  modified_base (302)..(302): a, c, t, g, unknown or other
  misc_feature (302)..(302): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccagcagtgacgttggtcttaataactatgtctctgtaaccaacaacaccagacaaacgccccaaatcataattangagtacactaacgccgccctcgacgggtcctgactcgtcttcctctcgccctaccgaaggcctacggccaaaccgacccgggtccccttccccgtacgtacccgttcgtccgtcggggtcctaccggagggtctaggaaggtacgtggacggtctagtatttattagttcggactagtcttacaatagtgacgaggtactaagttaactaagttgtagtaagttacggttcgggacggaacgggtaaacctaaacgttccggaccgttacgtaaggccaacgacccgaaggcctcccgccccgttcg

SEQ ID NO: 323607 - DNA, 582 bp, Homo sapiens
  misc_feature: GZ8MTXP01B8ZGL.4.39.D06.1.454.CMB.2.raw
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
  modified_base (453)..(453): a, c, t, g, unknown or other
  misc_feature (453)..(453): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggggtctcctggacagtcagtcaccatctcctgcactggaaccagcagtgtacgttggtcttaatactatgtctctgaccaacaacaccagacaaacnccccaatcatattangagtacactagcgcctgacgggtcctgactcgtcttcctctgcctaccgaaggctgaaccaacgacccgggtccctcccgtacgcccgtctcgtcgggctccgaggctaggacgatggagtctagtattattacttgctagtctacattagngacgtaggactaagttaacagttgtagtaagtacgttcggggaacggacgggtaaaccctaacgttaccggttaccgttaccgtaaggtccgaacgcccgttacggcctaacccggttccccgttaacg

SEQ ID NO: 323608 - DNA, 564 bp, Homo sapiens
  misc_feature: GZ8MTXP01EJEGK.4.39.D06.1.454.CMB.2.raw
  modified_base (287)..(287): a, c, t, g, unknown or other
  misc_feature (287)..(287): n is a, c, g, or t
  modified_base (422)..(422): a, c, t, g, unknown or other
  misc_feature (422)..(422): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactatgtctcctggtaccaaacaacacccaggacaaacncccccaaattcataaatttatgaggtacactaaagcggccctcgaggggtccctagatcgccttctctgcctcccaaggcctggccaaacaccgggccctccccgtgaccgtctctgggctccaggctgaggacngtaggctgattattattgcgagtcctanagtatcgngtacgagtattaacaaatgtgtaattacgttcgggggacgaggggaaccaaaacgttgttccggttaccctaaggtcaaccgaccgtagcctcgcccccgtaacgg

SEQ ID NO: 323609 - DNA, 561 bp, Homo sapiens
  misc_feature: GZ8MTXP01C4MT4.4.39.D06.1.454.CMB.2.raw
  modified_base (225)..(225): a, c, t, g, unknown or other
  misc_feature (225)..(225): n is a, c, g, or t
  modified_base (293)..(293): a, c, t, g, unknown or other
  misc_feature (293)..(293): n is a, c, g, or t
  modified_base (364)..(364): a, c, t, g, unknown or other
  misc_feature (364)..(364): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctctcactcagggcacagggtcctgggcccagtctgccctgactcagccctccctccgcgtccggtctcctggacagtcagtcacatctctgcactggaaccngcagtgacgttggcttatactatgtctctgaccaacaacaccagacaaacgccccaaatcataattangagtcactaagcgccctcgacggggtccctgactcgcttcctctgcctcaagctgcaacaccggccctccncgaccgtctcgtcggctccagggctaggacgatcggaggtctagtattaagttatgcgagtcctacatagtgacgaggtactaagttacaatggtagtaacgtagttcgggacggttagggtaaacccaacgttacggaccgttccgtaaggtaccgaaccggacccgtacggttacctccggaaccccccgttggg

SEQ ID NO: 323610 - DNA, 707 bp, Homo sapiens
  misc_feature: GZ8MTXP01BQP5R.4.39.D06.1.454.CMB.2.raw
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttaataactatgtctcctggaccaacaacacccaggacaaacgcccccaaattcataattangagtcaataacgcgccctgacggggtccctgactcgcttccnctcgcctaccgaaggtcctaggccaaaccgacccgggtccctaccccgtcgtacccgtcgtccgtcgggtccttacccgagggccttaggaggtaacgtggaaggtccgttaggactttaattaagtttcgaccgtaacggtccgttacctaagtttaatcggtacccgaagggttaccccgtaaagggtttaaacctaaaacggtttcggttaacgggttaaagtttacgggtttaccgggggaacggggttaaacggggtaaacccctaaaccgttacgggttacccgttaccggttaacggtaccgaaccggaccccgtaaacgggttcccgtaacccgttcccccgttcccggg

SEQ ID NO: 323611 - DNA, 614 bp, Homo sapiens
  misc_feature: GZ8MTXP01BKN88.4.39.D06.1.454.CMB.2.raw
  modified_base (224)..(224): a, c, t, g, unknown or other
  misc_feature (224)..(224): n is a, c, g, or t
  modified_base (290)..(290): a, c, t, g, unknown or other
  misc_feature (290)..(290): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctctcactcaggcacagggtcctgggcccagtctgccctgactcagcctcctccgcgtccggtctcctggacagtcagtcacatcctctgcactggaaccngcagtgacgttggtcgttatactatgtctctagaccaacacaccagacaaacgccccaatcatatngagtcatagcgcctgacgggtcctgtactcgtcttcctctcgccctcgaaggtcctacgggcaaaccgtccgggcccttcccgtacggtaccgttcgtcgtcggtctaccggagcgtaggaggtagtacggtagtcttagttattattagttcgactagtacctactaagtgtacgaccgtagggtaacttacgttaaacgtaagttgttaggtaagtttacgggttacccggggagggttaccggaaaccctaacgttaccgggttacgttaccgttaacggacgtaacccgccggaccggccttcccggaacccccgtttcg

SEQ ID NO: 323612 - DNA, 566 bp, Homo sapiens
  misc_feature: GZ8MTXP01D90HH.4.39.D06.1.454.CMB.2.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (301)..(301): a, c, t, g, unknown or other
  misc_feature (301)..(301): n is a, c, g, or t
  modified_base (453)..(453): a, c, t, g, unknown or other
  misc_feature (453)..(453): n is a, c, g, or t
tcagagcactgtagcacgaccggtgctcgatttagtgacatctcgcagttctttgggggggggtctcaggaggcagcgctctcaggacgtcaccaccatggcctgggctctgctcctcctcaccctcctcactcaggcacagggtcctgggcccagtctgccctgactcagccctccctccgcgtccggtctcctggacagtcagtcaccatctcctgcactggaaccngcagtgacgttggtacttatactntgtctctagaccaacacaccagacaaacgccccaaatcaattaattangagtcaactacgccgccctgacgggtcctgactcgcttcctctcgcctcgaagctgccaaacgcccggtccctcccgtcgacccgtctcgtcggcctccgagctggaggtacgtggagtctagtatttattacgttgactagtctacattanggacaggactagttaacaagttgagtaatacggttcgggacgaacgggtaacctaacgttcgttccgttacgtaaggtcaaccggcccgacggccgtcccgttccccgttccg

SEQ ID NO: 323613 - DNA, 563 bp, Homo sapiens
  misc_feature: GZ8MTXP01CX37J.4.39.D06.1.454.CMB.2.raw
  modified_base (301)..(301): a, c, t, g, unknown or other
  misc_feature (301)..(301): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccagcagtgacgttggtcttaataactatgtctctgaccaacaacaccagacaaacgccccaaattcaatattangagtacactagcgccctgacgggtcctgatcgcttcctctcgccctaccgaaggcctcggccaaacgacccggtccctcccgtacgacccgtctcgtcgggctccgaggctggacggatggaggtctagtatttattattcgctaagtctacagtatgcgaggtactaagttacaagtgtagaattagttcgggacggacggtaaactacgttacgttcccgttacgtaaggtacaacggcccgaggcctccgccccgttcg

SEQ ID NO: 323614 - DNA, 599 bp, Homo sapiens
  misc_feature: GZ8MTXP01EM8YF.4.39.D06.1.454.CMB.2.raw
  modified_base (302)..(302): a, c, t, g, unknown or other
  misc_feature (302)..(302): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcatggaaccagcagtgacgttggtacgttataactatgtctctggaccaacaacaccagacaaacgccccaaatcataattangagtcaactagccgccctcgacgggtcctgatcgcttccctctgccctccgaaggctgggcaaacgccggccctccctgtacccgtctcgtcggctccgaggctggaggatggaggtctagtatttagttagttgaccggtagtccttaacagtagtcgacgtaaggtacttaagttaacaagttcggtaagtaacgttacggttcgggacggttaaacggtaaaccgtaacgccggttaccgttaccgtaaggccgtaaccggacccgtacggttcccgtcccgttccccgtaacg

SEQ ID NO: 323615 - DNA, 560 bp, Homo sapiens
  misc_feature: GZ8MTXP01BZCPF.4.39.D06.1.454.CMB.2.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcttataactatgtctcctggtaccaacaacaccaggacaaacacccccaaattcaataatttangagtcactaagcgccctcgacggggtccctgactcgcttcctctgcctccaaggctggcaacacggccctccctgaccgtctcgtgggcctccgagctggaggatggaggctgattattagttgcagtctacattatgcgaggctagttacaatgtagtaatcgttcgggacggacgggaacctaaacgttcggacccgttcgtaagggtaccaacggaccccgtaggcccttaaccgcccccgttaaccggg

SEQ ID NO: 323616 - DNA, 589 bp, Homo sapiens
  misc_feature: GZ8MTXP01DI6A7.4.39.D06.1.454.CMB.2.raw
  modified_base (228)..(228): a, c, t, g, unknown or other
  misc_feature (228)..(228): n is a, c, g, or t
  modified_base (349)..(349): a, c, t, g, unknown or other
  misc_feature (349)..(349): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccngcagtgacgttggtcgttataactatgtctctgaccaacaacaccagacaaacgaccccaaattcaataattatgagtcactaacgcggccctcgacgggtccctgactcgcttcctctcncctcaaggctgcaaacaccggcctcccgtcgaccgtctcgtgggcctccgaggctgaggtatgaggctagtattattatgacagtctacatagtgacaggtactaagttaactaagtggtagtaagttaacggttcgggaacgggaacggggtaaaccctaaacgttcggttacccgttaccgttaagggaccaaccggtacccgaacgggttcccttcccggttcccccggttcccggg

SEQ ID NO: 323617 - DNA, 621 bp, Homo sapiens
  misc_feature: GZ8MTXP01CP4LI.4.39.D06.1.454.CMB.2.raw
  modified_base (230)..(230): a, c, t, g, unknown or other
  misc_feature (230)..(230): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
tcagagcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccngcagtgacgttggtcttatactatgtctctgaccaacacaccagacaaacncccctaaatcataattangagtcactaagcgccctcgacgggtcctgactcgcttcctctcgcctccgaaggtctcggcaaaccgacccgccctcccgtcgacccgtctcgtcgggcctccgaggctaggaggtatggagtcttagtaatttattagttcgacgtacgtcttacattagtcggacgtaggtacctaagttaactaaagttggtagtaagttacggttccggggaacgggaaccgggtaaacccgtaacgttccggttacccgttacccggtaaggtacccgaaccggacccgtaacgggttcccctcccggttaaccccccgtttcccgg

SEQ ID NO: 323618 - DNA, 569 bp, Homo sapiens
  misc_feature: GZ8MTXP01C5RBU.4.39.D06.1.454.CMB.2.raw
  modified_base (229)..(229): a, c, t, g, unknown or other
  misc_feature (229)..(229): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcttaataactatgtctctgtaccaacaacaccagacaaacgccccaaatcaataattatgagtacactaagccgccctcgacggggtcctgactcgcttccctctcgcctaccaaggtctggccaaacgaccgccctcccgtcgacccgtctcgtgggctccgaggctggacggatgaggtctgtaattattattgcgtagtcttacagttatgcaggtacaagtttaacaatgttagaagttacgttcgggacggagggtaaaccctaagttacggcccgttacgtaacggtcaacggccctagggttcctccgcccccgttcgg

SEQ ID NO: 323619 - DNA, 602 bp, Homo sapiens
  misc_feature: GZ8MTXP01BK09R.4.39.D06.1.454.CMB.2.raw
  modified_base (226)..(226): a, c, t, g, unknown or other
  misc_feature (226)..(226): n is a, c, g, or t
  modified_base (293)..(293): a, c, t, g, unknown or other
  misc_feature (293)..(293): n is a, c, g, or t
  modified_base (459)..(459): a, c, t, g, unknown or other
  misc_feature (459)..(459): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcaggcacagggtcctgggcccagtctgccctgactcagccctccctccgcgtccggtctcctggacagtcagtcaccatctctgcactgaaccngcagtgacgttgtcgttaatactatgtctctgaccaacacaccagacaaacgccccaatcatattangagtcatagcgcctgacgggtcctgactcgtcttcctctcgccctaccgaagcgtggccaacaccgggtccctcccgtcgtacccgtcgtccgtcgggtcctccgaggtcgtaggaacggtagtagggacgtcgtagtaatttagttattcgacgtaacgtcttanataagtcgacgtacggattaagttacaagttgtagtaattacggttacgggacgggttaaacggtaaaccgaacgttccgggacccttacggaaccggtacgaaccggaacccgacgggttccctccccggttccccgttccg

SEQ ID NO: 323620 - DNA, 646 bp, Homo sapiens
  misc_feature: GZ8MTXP01BMTO1.4.39.D06.1.454.CMB.2.raw
  modified_base (229)..(229): a, c, t, g, unknown or other
  misc_feature (229)..(229): n is a, c, g, or t
  modified_base (293)..(293): a, c, t, g, unknown or other
  misc_feature (293)..(293): n is a, c, g, or t
  modified_base (494)..(494): a, c, t, g, unknown or other
  misc_feature (494)..(494): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttatatatgtctctgacaacacaccagacaaacgccccaatcataattngagtcactagcgccctgacgggtcctgactcgtccttcctctcgccctaccgaacggccttacgggccaaacccgacccgggtcccctccccgtacggtaccccgttcgttccgtcgggccttaccgacgggtctagggaggtacgtcgggaggtcttaggtacttttaagttagtttcggactacgtcttacaagtttanaggtaccgaggttaccgtaaggtttaaccagttggtagtaagttaacggttcggggacgggttaacgggaaacccgtaaacgttccggttaaccgttccggtaacggtccgaacggcccgtaacggcccgtcccggttcccccgttaaccgg

SEQ ID NO: 323621 - DNA, 560 bp, Homo sapiens
  misc_feature: GZ8MTXP01AG8C8.4.39.D06.1.454.CMB.2.raw
  modified_base (230)..(230): a, c, t, g, unknown or other
  misc_feature (230)..(230): n is a, c, g, or t
  modified_base (303)..(303): a, c, t, g, unknown or other
  misc_feature (303)..(303): n is a, c, g, or t
  modified_base (449)..(449): a, c, t, g, unknown or other
  misc_feature (449)..(449): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcttataactatgtctctgtaccaacaacaccagacaaacgccccaaattcaataattangagtcactaagcgccctcagtcggtccctgactcgtccttctctcgccctccgaaaaggctcggcaaacgaccggccctcctcgacccgtctcgtcgggctccgaggctggaggatgaggctgattattatggcagctacattagngacgagctaatacagtgtaatagttacgtacggacggtaacggaaccttaacgttcgttaccgtaacgtacggtccgaaccggtacccgacggtcccgttcccggtccccg

SEQ ID NO: 323622 - DNA, 575 bp, Homo sapiens
  misc_feature: GZ8MTXP01CSWXC.4.39.D06.1.454.CMB.2.raw
  modified_base (298)..(298): a, c, t, g, unknown or other
  misc_feature (298)..(298): n is a, c, g, or t
  modified_base (346)..(346): a, c, t, g, unknown or other
  misc_feature (346)..(346): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggaaccagcagtgacgttggtcttataactatgtctctgaccaacaacaccagacaaacgccccaaatcataattangagtcactaagccggccctcgacggggtccctgactcgtcttcctctnccctccaagctgcaacacggccctccctgaccgtctcgtgggtcctcgaggctgaggatggagctagatttatagtgactagtctctagtatgacgaggtactagttaacgaagttgtaggtaattacggttacggggacggttaacgggaaacctaacgttcggacccgttaccgtaagggtaccaacggacccccgtaaggccccttaacccggttcccccgttcgg

SEQ ID NO: 323623 - DNA, 752 bp, Homo sapiens
  misc_feature: GZ8MTXP01CO17U.4.39.D06.1.454.CMB.2.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcacatctctgcactggaaccngcagtgacgttggtcttataactntgtctctgaccaacacaccagacaaacnccccaaattcaatattangagtacactaagcggccctcgacggggtcctgtactcgcttcctctcgcctacgaacggcctgggaacctaaaccgacccgggtccccttaccccgtcggtaccccgttcgtcccgttcggggtcccttaccggaacgggtccgttaacggggaaacgggtacgttaggggtaacggtccgttaagggttaacttttaaaagtttacgtttcgggtaccgtaaacgggttccttaacctaaacggttagttaccggaccgtaacggggttacctaaagggtttaaacctaaaggtttacggttacggtaaagtttaacgggtttccgggggaaccggggttaaaccgggaaaaacccgtaaccgttacccgggttaacccgttaccggtaaacgggtacccaacgtaccccgggtaaacggttcccgttaaccccggttcccccgtttaaccggg

SEQ ID NO: 323624 - DNA, 638 bp, Homo sapiens
  misc_feature: GZ8MTXP01CWZ5C.4.39.D06.1.454.CMB.2.raw
  modified_base (283)..(283): a, c, t, g, unknown or other
  misc_feature (283)..(283): n is a, c, g, or t
  modified_base (299)..(299): a, c, t, g, unknown or other
  misc_feature (299)..(299): n is a, c, g, or t
tcagagcactgtagcacgaccggtgctcgatttagtgacatctcgcagtttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctctgcactggaaccagcagtgacgttggtacgttataactatgtctctgaccaacacaccagacaaacnccccaaatcatattangagtcactagccgccctcgacgggtccctgactcgcttcctctcgcctccaaggcctggccaacaccggtccctcccgtgacccgtctccgtcgggcctccgaggtcctaggaggagtggaggtcttagtaatttattagttcggactaaggtccttactaagttacgtcggacgtacgggtacctaaaggtttaacaagttgggttagtaacgttacggttccgggggaacgggttaaacgggtaaacccgtaaacgttccgggttaccccgttaccggtaagggtacccgaacggtaccccgaacgggttccctaacccggttccccccgttaacgg

SEQ ID NO: 323625 - DNA, 579 bp, Homo sapiens
  misc_feature: GZ8MTXP01EYIDN.4.39.D06.1.454.CMB.2.raw
  modified_base (232)..(232): a, c, t, g, unknown or other
  misc_feature (232)..(232): n is a, c, g, or t
  modified_base (481)..(481): a, c, t, g, unknown or other
  misc_feature (481)..(481): n is a, c, g, or t
tcagagcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccaccatctcctgcactggaaccngcagtgacgttggtcttataactatgtctcctagaccaacaacaccagacaaacgaccccaattcaataattatagagtcaactacgccggccctcgacggggtccctgactcgcttcctctcgcctacaaggctcggccaacgaccgggtccctccctacggtacccgtcgtccgtcggctccgaggctggacgtagtgaggtctagtatttatagttgcagtctacatatgacgagtactagttaanatggtagtaagttacgttacgggacggaaacgggaacctaaacgttcgaccgttacgtaaggtacaacggtacccgaggcctcccggccccgttccgg

SEQ ID NO: 323626 - DNA, 579 bp, Homo sapiens
  misc_feature: GZ8MTXP01D6CWX.4.39.D06.1.454.CMB.2.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (300)..(300): a, c, t, g, unknown or other
  misc_feature (300)..(300): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacgagggtcctgggcccagtctgccctgactcagccctccctccgcgtccggtctccgtggacagtcagtcaccatctctgcactggaaccngcagtgacgttggtcttatactatntctctgaccaacaacaccagacaaacgccccaaattcataattangagtcatagcgccctgacgggtcctgactcgcttcctctcgccctacgaggctcggcaacgacccggccctacccgtcgacccgtcgttcgtcgggcctccggaggtctaggaggtatcggaggtctagttacttattagttcgcgagtactcgaatagtcgactaggtactagttaacagttgtagaagtaacgttcggggaacggttaaggaaaccctaacgttacgccgttactaacggaccgaacgtacccgagccctccgttccccgttaacgg

SEQ ID NO: 323627 - DNA, 597 bp, Homo sapiens
  misc_feature: GZ8MTXP01BWWTI.4.39.D06.1.454.CMB.2.raw
  modified_base (228)..(228): a, c, t, g, unknown or other
  misc_feature (228)..(228): n is a, c, g, or t
  modified_base (301)..(301): a, c, t, g, unknown or other
  misc_feature (301)..(301): n is a, c, g, or t
  modified_base (421)..(421): a, c, t, g, unknown or other
  misc_feature (421)..(421): n is a, c, g, or t
tcagagcactgtagcacgaccggtgctcgatttagtgacatctcgcagttcgtttggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatcctcctgcactggaaccngcagtgacgttggtcttaataactatgtctcctgtaccaacaacaccagcaaacgccccaaattcaatattangagtcaatagcgccctgacgggtccctgactcgcttcctctgcctcaagctcggcaaacgccggcctcccgtgacccgtctccgtgggcctaccgagggcttaggaggtactggacggtntagtattattagtcgcgacgtctactatacgcgacgagtactaagttaactaagttcgtagtaagttacggttacgggacgggttaacgtaaacccgtaaacgttaccggttaccgttaccggtaacggtccgaaccggtacccgtacggttcccgtcccggttcccccgtaacgg

SEQ ID NO: 323628 - DNA, 545 bp, Homo sapiens
  misc_feature: GZ8MTXP01AY94T.4.39.D06.1.454.CMB.2.raw
  modified_base (230)..(230): a, c, t, g, unknown or other
  misc_feature (230)..(230): n is a, c, g, or t
  modified_base (304)..(304): a, c, t, g, unknown or other
  misc_feature (304)..(304): n is a, c, g, or t
  modified_base (415)..(415): a, c, t, g, unknown or other
  misc_feature (415)..(415): n is a, c, g, or t
tcagagcactgtagcacgaccggtgctcgatttagtgacatctcgcagttctttgggggggtctcaggaggcagcgctctcaggacgtcaccaccgtggcctgggctctgctcctcctcaccctcctcactcagggcacagggtcctgggcccagtctgccctgactcagcctccctccgcgtccgggtctcctggacagtcagtcaccatctcctgcactggaaacccngcagtgacgttggtcgttataactatgtctctggtaccaacaacacccagcaaagcccccaaattcataattangagtcactaagcgccctcagggtccctgactcgcttctcctgcctcgaaggctaggccaacaccggccctcccgtgacccgtctctcgggcctccgaggctggaggatggnggctgatttattattgcacggtctacgatacgtgcagggctaagttacaagtgtgattaacgttggcggacgggaccaaacgtgacccgttcttacggtcacgcccaaggccttacgccccgttcggtcc

SEQ ID NO: 323629 - DNA, 594 bp, Homo sapiens
  misc_feature: GZ8MTXP01AI8TR.4.39.D06.1.454.CMB.2.raw
  modified_base (230)..(230): a, c, t, g, unknown or other
  misc_feature (230)..(230): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcttaatactatgtctctgaccaacacaccagacaaacgccccaaattcaataattatgagtcactaagcgccctcgacgggtcctgactcgtcttcctctcgccctaccgaaggtcctaggccaaaccgaccgggccctccccgtcgacccgtctcgtcgggcctccgaggctaggaggatggacgtctagattatattgcagctnatntgcaggctagttacaagtgtgtaagtgttcgggacgggaacgggtaaacctaaacgttcggttacccggttacccgtaacggggttacccaaccgggtaaccccgtaacgggttcccgttcccggccccccgtttcccggg

SEQ ID NO: 323630 - DNA, 529 bp, Homo sapiens
  misc_feature: GZ8MTXP01A22S2.4.39.D06.1.454.CMB.2.raw
  modified_base (302)..(302): a, c, t, g, unknown or other
  misc_feature (302)..(302): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgcccctgactcagcctccctcgcgtccggtctcctggacagtcagtcaccatctcctgcactggaaccagcagtgacgttggtcgttataactatgtctctggtaccaacaacaccaggcaaacgccccaaattcatatttangagtcataagcgccctcacggggtcctgactcgcttcctctgcctcaggctggcaacaccggcctccctgaccgtctcgtcgggctcgaggctgagatgagctgattatattgcgagctcaatgtgacaggcagttacaattgtgaataagttcgggcgaacggggaacctaaacgttcgaccgttccgttaagcaacgcccgaagggcctaaccgccccgttccgg

SEQ ID NO: 323631 - DNA, 596 bp, Homo sapiens
  misc_feature: GZ8MTXP01AGGTV.4.39.D06.1.454.CMB.2.raw
  modified_base (298)..(298): a, c, t, g, unknown or other
  misc_feature (298)..(298): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgaccaacacaccagacaaacgccccaaatcataattangagtcactaagcgccctcgacggggtccctgactcgtcttcctctcgccctaccgaagcctggccaacgaccggccctcccgtgacccgtctcgtcgggctccgaggcgtggaggtatggaggtctagtatttattagttgcgtagcttacattagtcgcgagggactaggttacaagttggtagtaagttacggttcgggacgggaacgggtaaacctaaacgttccggttaccggttaccgtaagggtccaacgggaccccgaagggttcccgtcccggttaacccccgttccggg

SEQ ID NO: 323632 - DNA, 608 bp, Homo sapiens
  misc_feature: GZ8MTXP01EXW2J.4.39.D06.1.454.CMB.2.raw
  modified_base (234)..(234): a, c, t, g, unknown or other
  misc_feature (234)..(234): n is a, c, g, or t
  modified_base (307)..(307): a, c, t, g, unknown or other
  misc_feature (307)..(307): n is a, c, g, or t
  modified_base (421)..(421): a, c, t, g, unknown or other
  misc_feature (421)..(421): n is a, c, g, or t
tcagagcactgtagcacgaccggtgctcgatttagtgacatctcgcagttcgtttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactaggaaccngcagtgtacgttggtcttataactatgtctctgtaaccaacaacaccagacaaacgccccaaattcatattangagtcaatagccgccctcgtacgggtcctgactcgctttcctctcgccctaccgaacggctcggccaaccgacccggtccctccctcgtaccgtctcgtcgggcctccgaggcnggaggtagtcggtaggtcttagtactttattagttcgacagttctacaagttagcgacgtacgggtaccttaaaggttaactaagttcggtaagtaacgtttacgggttcggggacggttaacggaacctaacgttcgttaccgttcgtaaggctaaccgcgacgccgtcccgttccccgttaaccg

SEQ ID NO: 323633 - DNA, 628 bp, Homo sapiens
  misc_feature: GZ8MTXP01A88YM.4.39.D06.1.454.CMB.2.raw
  modified_base (228)..(228): a, c, t, g, unknown or other
  misc_feature (228)..(228): n is a, c, g, or t
  modified_base (343)..(343): a, c, t, g, unknown or other
  misc_feature (343)..(343): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtcaccatctcctgcactggaaccngcagtgacgttggtcgttataactatgtctcctggaccaacaacaccagacaaacgccccaaattcaataattatgagtcaactagcgccctagacgggtccctgatcgcttccnctcgcctacaggctaggcaacacggtccctccctcgacctctcgtcgggcctccgaggctaggacggtatggaggtctagtatttattagttcggactaggtaccttcaagttagtcgacgtaacggtacctaggtttaaaccaaagttcggttaaggtaagtttaaccggtttacgggggaaccgggttaaacggggtaaacccaaaacgttcggttacccgttaccgtaacgggtccgaacgtaccccggaagttcccgtaacccgttcccccgttaaccggg

SEQ ID NO: 323634 - DNA, 552 bp, Homo sapiens
  misc_feature: GZ8MTXP01AJSBY.4.39.D06.1.454.CMB.2.raw
  modified_base (299)..(299): a, c, t, g, unknown or other
  misc_feature (299)..(299): n is a, c, g, or t
  modified_base (434)..(434): a, c, t, g, unknown or other
  misc_feature (434)..(434): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgacgttggtcttataactatgtctctgaccaacacaccagacaaacgccccaaattcataattangagtcactagccggccctcgacggggtccctgatcgcttcctctgccctccgaaggctggcaacgaccggtccctccctcgaccgtctcgtcggctcgagctgagatgaggctagtattattattgcgtagtctnatagtgcgaggtactagttacagtgtagtaattacggttcgggacggttaacgggaacctaacgttcgccgttaccgtaagtccgaacgccccgaggccttccggcccccgttaacgg

SEQ ID NO: 323635 - DNA, 681 bp, Homo sapiens
  misc_feature: GZ8MTXP01ARSO0.4.39.D06.1.454.CMB.2.raw
  modified_base (230)..(230): a, c, t, g, unknown or other
  misc_feature (230)..(230): n is a, c, g, or t
  modified_base (309)..(309): a, c, t, g, unknown or other
  misc_feature (309)..(309): n is a, c, g, or t
  modified_base (355)..(355): a, c, t, g, unknown or other
  misc_feature (355)..(355): n is a, c, g, or t
tcagagcactgtagcacgaccggtgctcgatttagtgacatctcgcagttctttgggggggggtctcaggaggcagcgctctcaggacgtcaccaccatggcctgggctctgctcctcctcaccctcctcactcagggcacgagggtcctgggcccagtctcgccctgactcagcctccctccgcgtccgggtctcctggacagtcagtcacatctctgcactggaaccngcagtgtacgttggtacttaataactatgtctctagtaccaacaacaccagacaaacgacccctaaatcaattaattangagtacaacgtaacgccgtcctcgacgggtcctgactcgtcttccnctcgcctacgaaggctacggcaacgtaccggccctccgtcgacccgtctcggtcggtctaccgaggtcgtaggaggtagtacggaggtcttaggtatttaacttacgttcgacggtacggtactactaagttactacggacgtaacgggtacctaaacggttaactaaggttacggttaaggtaaacgtttaccggggttacgggggaacccggggttaaacgggtaaaccccgtaaaacgttccggttaacccggttaccggttaacggaccgaaccggttaacccggacgggttaccccgttccccggttaaccccgttccggg

SEQ ID NO: 323636 - DNA, 556 bp, Homo sapiens
  misc_feature: GZ8MTXP01AV1UH.4.39.D06.1.454.CMB.2.raw
  modified_base (252)..(252): a, c, t, g, unknown or other
  misc_feature (252)..(252): n is a, c, g, or t
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactntgtctctgaccaacacaccagacaaacgccccaatcataattangagtcactagcgccctcgacgggtccctgactcgcttcctctgcctcagctgcaacncgcctcctgtacgtctcgtggcctcgagctgagatcggagtctagtattattattgactagtctcattatcgacgaggtactaagttaacaagtgtagtaatacggttccggggacggaacgggtaaacctaaacgttcgacccggttcgtaacgggtcaaccgccccgtaaggttccctaacccggttcccccgttaacggg

SEQ ID NO: 323637 - DNA, 601 bp, Homo sapiens
  misc_feature: GZ8MTXP01DSAPU.4.39.D06.1.454.CMB.2.raw
  modified_base (228)..(228): a, c, t, g, unknown or other
  misc_feature (228)..(228): n is a, c, g, or t
  modified_base (496)..(496): a, c, t, g, unknown or other
  misc_feature (496)..(496): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtcccggtctcctggacagtcagtcaccatctctgcactggaaccngcagtgacgttggtcttaataactatgtctcctagtaccaacaacacccaggcaaacgcccccaaattcaattaatttatgagtacactaagccgtccctcgacgggtcctgtatcgtctttccctctcgccctacgaacggtctacggccaaaccgcccgggtaccctccccgtgacccgttctcgtcgggcctccgaggtcgtgaggtatggaggtctagtattattattgactagtcttacagttatcgcaaggtctaaagttanaaagttgtagtaattagttcgggacggttaaacgggaaaccaaacgttcgaaccgttaccgtgtaccaacgaccgtaacggcctaaccggttcccccgttaacgg

SEQ ID NO: 323638 - DNA, 602 bp, Homo sapiens
  misc_feature: GZ8MTXP01EZISL.4.39.D06.1.454.CMB.2.raw
  modified_base (303)..(303): a, c, t, g, unknown or other
  misc_feature (303)..(303): n is a, c, g, or t
  modified_base (458)..(458): a, c, t, g, unknown or other
  misc_feature (458)..(458): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttataactatgtctcctggaccaacaacaccaggacaaacgccccaaattcataatttangagtcactaagcggccctgacggggtccctgactcgtcttcctctcgcctcaacggctggcaaaccgaccggccctcccgtcgacccgtctcgtgggcctccgaggtctggacggtatggacggtctagtattatttagttgcctaggtccttanaattacgtgaccgagggtactaagttacaagttcggtagtaagttacgttcggggacggttaaacgggaaaccctaaacgttcggacccgttacgtaacgggtcaacggaccccgaagttcccgtccgttcccccgttaaccgg

SEQ ID NO: 323639 - DNA, 616 bp, Homo sapiens
  misc_feature: GZ8MTXP01CZI3L.4.39.D06.1.454.CMB.2.raw
  modified_base (229)..(229): a, c, t, g, unknown or other
  misc_feature (229)..(229): n is a, c, g, or t
  modified_base (299)..(299): a, c, t, g, unknown or other
  misc_feature (299)..(299): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctcctgcactggaaccngcagtgacgttggtcttataactatgtctctgaaccaacaacaccagacaaacgccccaaatcatattangagtcaactaagccgccctcgacggggtcctgatcgtcttcctctcgccctaccgaaggtccgtacgggcctaaaccgacccgggtccccttcccgtcggacccgttctcgtcgggcctccgaggctagacggatcggagtctgtattattatcgagacgtctacaagttgacgacgaggtactaaggttacaagtgtagtaacgttagttaccggggacgggaaggtaaaccctaacggttacggttacccgttaccgttaagggtaccgaaccggacccgtaacggttcccgttcccggttaaccccgttcccgg

SEQ ID NO: 323640 - DNA, 697 bp, Homo sapiens
  misc_feature: GZ8MTXP01CIVG3.4.39.D06.1.454.CMB.2.raw
  modified_base (392)..(392): a, c, t, g, unknown or other
  misc_feature (392)..(392): n is a, c, g, or t
tcagagcactgtagcacgaccggtgctcgatttagtgacatctcgcagttctttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctgtaccaacaacaccaggacaaacgcccccaaattcattaattatgagtcactaagcgccctcgacgggtccctgatcgctttctctcgccctcgaagccctgggaccaaccgaccggtccctcccgtcgacccgttcctccgtcggggcctcccgaggcctagggnggagtgggaacgggtcttagtaattttaagttactttcgacgtacgctactaattagttacgaccgaggaccgtaagttaactaagttaggttagtaacggttacggtttaccggggacgggtaaccgggaaaccctaaacgttaccggacccggttacccgtaacggtccgaaccggaccccgaaacggtcccgtacccggttcccccgttcccggttcctacccgttccttcccggtttcccccttacccccttcccgttaccccgttaaccgtacggtcgttccttccgttcggtaaccggg

SEQ ID NO: 323641 - DNA, 641 bp, Homo sapiens
  misc_feature: GZ8MTXP01BWHHP.4.39.D06.1.454.CMB.2.raw
  modified_base (229)..(229): a, c, t, g, unknown or other
  misc_feature (229)..(229): n is a, c, g, or t
  modified_base (282)..(282): a, c, t, g, unknown or other
  misc_feature (282)..(282): n is a, c, g, or t
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
tcagagcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgtacgttggtcttataactatgtctctgaccaacacaccagacaaacncccaatcatattangagtcactagcgccctcgacgggtcctgatcgcttccnctcgcctcagtctcggcaaccgccggccctccgtcgccgtctcgtcgggctccgaggctggacggagtacggacggtcgttagtaatttatttagttcgacgtacggtaccttactagttacgtcggaccgtaaggtaccgttaaggtttaaacctaaagttcggtaggtaacgttacgggtttccgggggaaccggggttaaacgggtaaacccgtaaaccggttcggttacccggttacccggtaagggtacccgaacggtaccccggacgggttcccgttaaccccggttcccccggttaacgg

SEQ ID NO: 323642 - DNA, 592 bp, Homo sapiens
  misc_feature: GZ8MTXP01AXS61.4.39.D06.1.454.CMB.2.raw
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
  modified_base (469)..(469): a, c, t, g, unknown or other
  misc_feature (469)..(469): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactatgtctctgaccaacacaccagacaaacnccccaaatcataattangagtcactaagcgccctcgacggggtccctgactcgtcttcctctcgcctccgaaggtccgtcgggaaccaaccgacccgggtcccttaccccgtcgacccgttctcgtcggggcctccggaggcgtggaggatggaggtctagtatttaattattgctagtctctaattancgcgaggtctaagttacaaattgtgtaattaggttaccgggacgggacggtaaacccaaacgttcggacccgttacgtaacggtcaacggacccaacgggttcctcccggcccccgttaacgg

SEQ ID NO: 323643 - DNA, 660 bp, Homo sapiens
  misc_feature: GZ8MTXP01AYWYT.4.39.D06.1.454.CMB.2.raw
  modified_base (228)..(228): a, c, t, g, unknown or other
  misc_feature (228)..(228): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctctgcactggaaccngcagtgacgttgtacttatactatgtctctgaccaacaacaccagacaaacnccccaaatcataattangagtcataacgcgccctcgacgggtccctgactcgtcttcctctgccctacgaacggctacggaaccaaacgacccggtccctacccgtggtaccccgtcgtcgtcgggccttaccgagggtccgttaggagggtacgtagggtcgggtacttagttaatttaagtttaagttcgaccgtaaggtccttactaagtttagcgacgtaagggaccttaaggttaaacaagttggttagtaacgtttacggttccggggaacgggttaacgggaaacccttaaacggttccggttacccgttacccggtaaggtaccgaaccggtaaccccggacgggttccccgtcccggccccccgtttccgg

SEQ ID NO: 323644 - DNA, 536 bp, Homo sapiens
  misc_feature: GZ8MTXP01BAKLS.4.39.D06.1.454.CMB.2.raw
  modified_base (297)..(297): a, c, t, g, unknown or other
  misc_feature (297)..(297): n is a, c, g, or t
  modified_base (456)..(456): a, c, t, g, unknown or other
  misc_feature (456)..(456): n is a, c, g, or t
tcagagcactgtagcacgaccggtgctcgatttagtgacatctcgcagttcgtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaacagcagtgacgttggtcttatactatgtctctgacaacaacaccagacaaacgccccaaatcatattangagtcactagcgccctcgagggtccctgactcgcttcctctcgcctcaaggctacggcaacgaccggccctcccgtcgacccgtctcgtcgggctccgaggctggacgtatgagctagattaattagttgctagtctcagtatgacgaggctaagttanaatgtagaattagttcgggacggacggaacctaagttcgaccgttacgtaagtcaacgccgagcctcccgaaccccgtcg

SEQ ID NO: 323645 - DNA, 634 bp, Homo sapiens
  misc_feature: GZ8MTXP01B4R53.4.39.D06.1.454.CMB.2.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (298)..(298): a, c, t, g, unknown or other
  misc_feature (298)..(298): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcttatactntgtctctgaccaacaacaccagacaaacgccccaaatcatattangagtcacgtagcgccctgacgggtcctgactcgtcttcctctcgccctaccgaaggtcctacgggccaaacccgacccgggtccccttccccgtacggaccccgttcgtccggttcgggcctcccggagggccgtaggacgggtatgggaacggtctagttatttaattagtcggcacgtctacattagtcgacgaggtactaagttacagttgtagtaacgttaggttccggggaacggttacgggtaaaccctaacggttcggttaaccccgttacgtaaccggtcgaaccggtcccgtaacgggttccctccccggttaacccccgtttccgg

SEQ ID NO: 323646 - DNA, 594 bp, Homo sapiens
  misc_feature: GZ8MTXP01A0SIB.4.39.D06.1.454.CMB.2.raw
  modified_base (300)..(300): a, c, t, g, unknown or other
  misc_feature (300)..(300): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctgaccaacaacaccagacaaacgccccaaattcataattangagtcaactaagcgccctcgacggggtccctgactcgcttcctctgccctaccaaggctcgggcaaaccaccgggtccctccctgacccgtctcgtcgggcctccgaggctaggaggatggaggtctgtaatttattattcggctacgctacagtatgcgaggactagttacaaatgtagtaattagttcggggacggaaacgggaacccaaaacgttcggttacccggttaccgttaacggggtaccaaccgggccccgaaggggttcccttcccggcccccccgtttccggg

SEQ ID NO: 323647 - DNA, 593 bp, Homo sapiens
  misc_feature: GZ8MTXP01BHAK4.4.39.D06.1.454.CMB.2.raw
  modified_base (230)..(230): a, c, t, g, unknown or other
  misc_feature (230)..(230): n is a, c, g, or t
  modified_base (300)..(300): a, c, t, g, unknown or other
  misc_feature (300)..(300): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcttataactatgtctctgaccaacaacaccagacaaacgccccaaatcataattangagtcagtagcgccctcgacgggtcctgatcgcttcctctcgcctcaggctggcaacgccggcctccctcgaccgtctcgtcgggctccgaggctggagagtggagtctagtatttattatcgcgagtctacagtatcgacgaggtactaagttaacgagttggtgtaagttacggttaccggggacgggaaacgggtaaacccgtaaacgttccggttacccgttccggtaacgggtacccaacggtaccccgtaagggttccccgttcccggttccccccggttaaccggg

SEQ ID NO: 323648 - DNA, 577 bp, Homo sapiens
  misc_feature: GZ8MTXP01DND0Q.4.39.D06.1.454.CMB.2.raw
  modified_base (230)..(230): a, c, t, g, unknown or other
  misc_feature (230)..(230): n is a, c, g, or t
  modified_base (303)..(303): a, c, t, g, unknown or other
  misc_feature (303)..(303): n is a, c, g, or t
  modified_base (424)..(424): a, c, t, g, unknown or other
  misc_feature (424)..(424): n is a, c, g, or t
tcagagcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctcctgcactggaaccngcagtgacgttggtcgttataactatgtctctgaccaacaacaccagacaaacgccccaaattcataatttangagtcactagcgccctcgacgggtcctgatcgcttcctctcgcctccaaggctgggcaaccaccgggtccctcccgtcgaccgtctcgtcgggctccgaggctggagatgagctgattatnttgcgagctacatagtcgacgaggtactaagttaacaagttggttagtaagttacgttcgggggacggttaaacggggaaaccctaaacgttcggacccgttcgtaaggtaccaacggtacccgaagggttccccgtccggcccccgttccgg

SEQ ID NO: 323649 - DNA, 619 bp, Homo sapiens
  misc_feature: GZ8MTXP01CWM3S.4.39.D06.1.454.CMB.2.raw
  modified_base (229)..(229): a, c, t, g, unknown or other
  misc_feature (229)..(229): n is a, c, g, or t
  modified_base (282)..(282): a, c, t, g, unknown or other
  misc_feature (282)..(282): n is a, c, g, or t
  modified_base (297)..(297): a, c, t, g, unknown or other
  misc_feature (297)..(297): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccngcagtgacgttggtcgttataactatgtctctgaccaacacaccagacaaacnccccaatcatattangagtcactagcgccctcgacgggtcctgatcgtcttccctctcgtccctacgaacggcctacgggcctaaaccgacccgggtccctccccgtacgtaccccgtcgtccgtcgggtcctcccgaggtcgtaggaggacgtggaggtctagtatttaattgttacggcctaagtcttactaagttacgtgcgtacggtacttagttaacaagttgtagtaagttacgttcggggacggaacgggtaaaccctaacgttcgttacccggttacgtaacggtaccaaccggacccgaagggttccctccggttcccccgttaacgg

SEQ ID NO: 323650 - DNA, 617 bp, Homo sapiens
  misc_feature: GZ8MTXP01CNNP7.4.39.D06.1.454.CMB.2.raw
  modified_base (228)..(228): a, c, t, g, unknown or other
  misc_feature (228)..(228): n is a, c, g, or t
  modified_base (301)..(301): a, c, t, g, unknown or other
  misc_feature (301)..(301): n is a, c, g, or t
  modified_base (376)..(376): a, c, t, g, unknown or other
  misc_feature (376)..(376): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcacatcctctgcactggaaccngcagtgacgttggtcttataactatgtctctgaccaacaacaccagacaaagaccccaaattcaataatttanagagtacactaagcgccctcgacggggtcctgactcgcttctctgccctcaaggcctggcaacaccggcctcccncgaccgtctcgtggcctcgaggctgaggtatgaggctgtaattattattgactacgtcttacaatacgtcgcgtacggtaccgtaagtttaacaagttagggtataacgtttaacggttcggggaccgggaaacgggtaaacccgtaaacgttacggttaccccgttaccgttaaacggggtaccctaacgggaacccccgtaacggggacccttcccgggttcccccccgtttaaccggg

SEQ ID NO: 323651 - DNA, 567 bp, Homo sapiens
  misc_feature: GZ8MTXP01EECU0.4.39.D06.1.454.CMB.2.raw
  modified_base (152)..(152): a, c, t, g, unknown or other
  misc_feature (152)..(152): n is a, c, g, or t
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (339)..(339): a, c, t, g, unknown or other
  misc_feature (339)..(339): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (469)..(469): a, c, t, g, unknown or other
  misc_feature (469)..(469): n is a, c, g, or t
tcagagcactgtagcacgaccggtgctcgatttagtgacatctcgcagttctttgggttttgggggaagtgtggtacggcctgggggtccctgagactctcctgtacagcctctggattctcctttgatgattatggcatgagctgggtccnccaagctccgagggagggctggagtggtgtctggtatgaattggagtggcgtagtacagcttangcagactntgtgaaggccatcacatcncagagacaacgcaagaactccctgtatctagcaattgaacagtctgagagccgagacacggtcctttgtattactgtgcgagaactagtttagggngtagtagtggtaaacngctnctattcgtcgacgttgggtttcacgtacgtggggccgaggggacgcccgttggtcctaccgtctccctcacgcctcccaccggaacggcccagtcccgtcccttccccgnggccgcccgtgcctccgacgcggccaccgttccgagcgaccacgacgccggcccgttggggcctcggtccctgggacctaacggttcctttaaccccg

SEQ ID NO: 323652 - DNA, 580 bp, Homo sapiens
  misc_feature: GZ8MTXP01AK4PA.4.39.D06.1.454.CMB.2.raw
  modified_base (230)..(230): a, c, t, g, unknown or other
  misc_feature (230)..(230): n is a, c, g, or t
  modified_base (304)..(304): a, c, t, g, unknown or other
  misc_feature (304)..(304): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
  modified_base (485)..(485): a, c, t, g, unknown or other
  misc_feature (485)..(485): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcactggaaccngcagtgtacgttggtcttataactatgtctctaggaccaacaacacccagacaaacgccccaaattcatattangagtcactagcgccctgacgggtcctgatcgcttcctctcgcctccaaggctacggcaacgacccgggtccctccccgtgtacccgtctcgtcgggcttccggaggctaggacggatggagtctagtattattagttgctagtcttanacttagngacgaggtactaacgtaataattggngtaaagttgttcggggaacgggacggtaaaccctaacggttcgaccgttcgtaacggtcgaaccgcccgtagggccctaacccggccccgttcgg

SEQ ID NO: 323653 - DNA, 532 bp, Homo sapiens
  misc_feature: GZ8MTXP01EX51V.4.39.D06.1.454.CMB.2.raw
  modified_base (229)..(229): a, c, t, g, unknown or other
  misc_feature (229)..(229): n is a, c, g, or t
  modified_base (296)..(296): a, c, t, g, unknown or other
  misc_feature (296)..(296): n is a, c, g, or t
  modified_base (406)..(406): a, c, t, g, unknown or other
  misc_feature (406)..(406): n is a, c, g, or t
  modified_base (434)..(434): a, c, t, g, unknown or other
  misc_feature (434)..(434): n is a, c, g, or t
  modified_base (452)..(452): a, c, t, g, unknown or other
  misc_feature (452)..(452): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccngcagtgtacgttggtacttatactatgtctctgacaacacaccagacaaacgccccaatcatattangagtcatagcgccctcgacgggtcctgactcgcttcctctcgcctcaacggctggccaacgaccggccctcccgtgtacccgtctcgtcggctccgaggctggacggtangagctagattattattgcagtctcatangacaggctagtacatgtnaattacggttcgggacggttacggaaccaacgttcgaccgttacgtaaggcaacgccgaaggcctccgttccccgtaacg

SEQ ID NO: 323654 - DNA, 619 bp, Homo sapiens
  misc_feature: GZ8MTXP01AXBAN.4.39.D06.1.454.CMB.2.raw
  modified_base (229)..(229): a, c, t, g, unknown or other
  misc_feature (229)..(229): n is a, c, g, or t
  modified_base (426)..(426): a, c, t, g, unknown or other
  misc_feature (426)..(426): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttaataactatgtctcctgaccaacaacaccagacaaacgccccaaattcataattatgagtcactaagccggccctcgacggggtccctgactcgtcttcctctcgccctcgaaggctggcaacgccggtccctcccgtcgacccgtctccgtcgggcctccgaggtctggaggactaggngtcgttagtagtttacttagttgacgtagtcctagacttagcgacgaggtactaagttaacaagttgtaggtaacttcggttcggggacggttaacgggaaacccgtaaacgttccgggttacccgttaccggtaaggtacccgaaccgaccccgtaacggggttcccttccccgggaaccccgtttcccggg

SEQ ID NO: 323655 - DNA, 617 bp, Homo sapiens
  misc_feature: GZ8MTXP01BDK0V.4.39.D06.1.454.CMB.2.raw
  modified_base (230)..(230): a, c, t, g, unknown or other
  misc_feature (230)..(230): n is a, c, g, or t
  modified_base (299)..(299): a, c, t, g, unknown or other
  misc_feature (299)..(299): n is a, c, g, or t
tcagagcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccngcagtgacgttggtacttatactatcgtctctgaccaacaacaccagacaaacaccccaatcatattangagtcactagcgccctcgacgggtcctgtactcgtcttcctctcgccctaccgaaggtcctacgggccaaaccgtcccgggtcccttccccgtacgtacccgttctccgtcgggcctccgaggctaggacgtagtggaggtactgtatttaattgttacgcgtacgtctaccgtattacgcgtacgaggtacctaagttagaagttgtagtaagttacggttcgggaacggttaacgggaaaccctaaacgttcggacccgttacggtaaggtccgaaccgtaacccggacggttccgtaacccgttccccgttccgg

SEQ ID NO: 323656 - DNA, 536 bp, Homo sapiens
  misc_feature: GZ8MTXP01EEP6G.4.39.D06.1.454.CMB.2.raw
  modified_base (230)..(230): a, c, t, g, unknown or other
  misc_feature (230)..(230): n is a, c, g, or t
  modified_base (297)..(297): a, c, t, g, unknown or other
  misc_feature (297)..(297): n is a, c, g, or t
  modified_base (325)..(325): a, c, t, g, unknown or other
  misc_feature (325)..(325): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccaccatctctgcactggaaccngcagtgacgttggtcttatactatgtctctgaccaacacaccagacaaacgccccaatcattattangagtcactagcgccctgacgggtcctgntcgcttcctctgcctcaacggctgcaacgaccgtccctcctcgaccgtctcgtcgggctccgaggcgtgaggatggagctgaatttattattcgcgagtcctanatatgcnggactagtacagtcgtgaattgttcgggacgaacgggtaaccaacgttcgttaccgttcgtaagggtcaacggtacccgagttcctccggccccgttcgg

SEQ ID NO: 323657 - DNA, 568 bp, Homo sapiens
  misc_feature: GZ8MTXP01BU3XV.4.39.D06.1.454.CMB.2.raw
  modified_base (302)..(302): a, c, t, g, unknown or other
  misc_feature (302)..(302): n is a, c, g, or t
  modified_base (465)..(465): a, c, t, g, unknown or other
  misc_feature (465)..(465): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctctgcactggaaccagcagtgtacgttggtcttatactatgtctctgaaccaacaacaccagacaaacgcccctaaatcaataattangagtacaactagccgccctcgacgggtcctgactcgtcttcctctcgccctaccaaggtcgtacgccaaaccgacccggtccctcccgtacgacccgttctcgtcgggcctcgaggctaggaggactggagctagatttaattagtgctagtctactatacgngacgtagtactaagttatagtggtagtaagtacggttcgggtacggaacggtaactaacgttcgttacgttcgtaaggcaacgacgacgccgtccgccccgtg

SEQ ID NO: 323658 - DNA, 535 bp, Homo sapiens
  misc_feature: GZ8MTXP01AH2AB.4.39.D06.1.454.CMB.2.raw
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
  modified_base (418)..(418): a, c, t, g, unknown or other
  misc_feature (418)..(418): n is a, c, g, or t
tcagagcactgtagcacgaccggtgctcgatttagtgacatctcgcagttcgtttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccagcagtgacgttggtcttataactatgtctctgtaccaacaacaccagacaaacgccccaaattcataattngagtcactagcgccctcgacgggtcctgatcgcttcnctncctcagcngcacgcgtcctccgngcctctcgcggctcgaggtctggagagtgagtctgtattattatgctagtctnatatcgcgtagactagtactagttcgtgtaagtgttacgggacggacggaaaccgtaaacgcggttaccgttcgtaaggtcgaacggacccgaacgttcccgtccgttccccgtcgg

SEQ ID NO: 323659 - DNA, 562 bp, Homo sapiens
  misc_feature: GZ8MTXP01A21H8.4.39.D06.1.454.CMB.2.raw
  modified_base (302)..(302): a, c, t, g, unknown or other
  misc_feature (302)..(302): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctctgcactggaaccagcagtgacgttggtacgttataactatgtctctagtaccaacaacaccaggcaaacgccccaaatcataattangagtcactaagccggccctgacggggtcctgactcgtcttcctctgccctccgaaggctggcaacgaccggtccctccctgaccgtcgtcgtcgggactccgaggctggaggactgaggtctgtattattagttcncgtagtctanatagtcgacgtaggtactaagttactagttcgtagtaagttacggttcgggacggacggaactaacgttcgccgttacgtaacgacgaacgaccgtcgttccgtccgcccgtcg

SEQ ID NO: 323660 - DNA, 546 bp, Homo sapiens
  misc_feature: GZ8MTXP01BV0KX.4.39.D06.1.454.CMB.2.raw
  modified_base (297)..(297): a, c, t, g, unknown or other
  misc_feature (297)..(297): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttatactatgtctctgaccaacacaccagcaaacgccccaaatcatattangagtcactaagcgccctcgacgggtcctgatcgcttcctctgccctccaaggctggcaacgaccggccctccctgaccgtctcgtgggctccgaggctgagactgagctgtattattagttgcagtctacagtatcgcgaggtactaacgttacaagttgtagtaagttacgttcggggacggacgggtaacctaaacgttcgttaccgttcgtaaggtccaacgccgaggcctccgccccgttaacgg

SEQ ID NO: 323661 - DNA, 547 bp, Homo sapiens
  misc_feature: GZ8MTXP01CJTYZ.4.39.D06.1.454.CMB.2.raw
  modified_base (228)..(228): a, c, t, g, unknown or other
  misc_feature (228)..(228): n is a, c, g, or t
  modified_base (295)..(295): a, c, t, g, unknown or other
  misc_feature (295)..(295): n is a, c, g, or t
  modified_base (353)..(353): a, c, t, g, unknown or other
  misc_feature (353)..(353): n is a, c, g, or t
  modified_base (424)..(424): a, c, t, g, unknown or other
  misc_feature (424)..(424): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaaccngcagtgacgttggtcttatactatgtctctgaccaacaacaccagcaaacgccccaatcataattangagtcacagcgccctgacgggtcctgactcgtcttcctctgcctcaaggctcgcaacnccggcctccgtgaccgtctcgtcgggctccgagctggacgatgaggctagtattattatgcagtctcatangtcaggtacagttacagtgtcgaagttcgttcgggaacggacggtaaccctaaacgttcggacccgttaccgtaaggtcccgaacggcccgtaacgggttccctcccggaacccccgtttcgg

SEQ ID NO: 323662 - DNA, 526 bp, Homo sapiens
  misc_feature: GZ8MTXP01DX97C.4.39.D06.1.454.CMB.2.raw
  modified_base (230)..(230): a, c, t, g, unknown or other
  misc_feature (230)..(230): n is a, c, g, or t
  modified_base (301)..(301): a, c, t, g, unknown or other
  misc_feature (301)..(301): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (420)..(420): a, c, t, g, unknown or other
  misc_feature (420)..(420): n is a, c, g, or t
tcagagcactgtagcacgaccggtgctcgatttagtgacatctcgcagttcgttttggggggggtctcaggaggcagcgctctcaggacgtcaccaccatggcctgggctctgctcctcctcaccctcctcactcagggcacagggtcctgggcccagtctgccctgactcagccctccctccggcgtccggtctcctggacagtcagtcacatctctgcactggaaccngcagtgacgttggtacttataactatgtctctagaccaacacaccagacaaacgccccaaatcaatattangagtacatagcgaccctgacgggtcctgattgcttctctgcctacagctacgcaaacnccggtcctcccngaccgtctcgtggctccgaggctagagatggagctgtattatattgcantcatatgagagtatagtatatgtgtaagtagttacggacggacggaacgtaacgttacgttcgttacgtaacgtacgaacgacgacgttccgtccgttcccgtccg

SEQ ID NO: 323663 - DNA, 634 bp, Homo sapiens
  misc_feature: GZ8MTXP01B5VP2.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatcctcctgcactggaaccagcagtgtacgttggtacgttaataactatgtctcctgaaccaacaacacccagacaaacgcccccaaattcaattaatttatgacgtcactaacgccggtccctcgacggggtcccctgactcgtcttcctctcgccctccgaaggtcctggccaaacgacccggtccctccctcggacccgtcgtcgtcgggcctccgaggcctaggaggtactgggacgtctaggtatttattagttcgacgtagtcctactagtagtcgacgtaggtactaaggttaacaagttggtagtaacgttacggttccggggaacggacggaaaccctaacgttcgttacccgttccgttaagggtcccgaacgtcccggaacggttccctaacccgggttcccccgttaaccgg

SEQ ID NO: 323664 - DNA, 615 bp, Homo sapiens
  misc_feature: GZ8MTXP01C4GQL.4.39.D06.1.454.CMB.2.raw
  modified_base (276)..(276): a, c, t, g, unknown or other
  misc_feature (276)..(276): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
  modified_base (327)..(327): a, c, t, g, unknown or other
  misc_feature (327)..(327): n is a, c, g, or t
tcagagcactgtagcacgaccggtgctcgatttagtgacatctcgcagttctttgggggggggtctcaggaggcagcgctctcaggacgtcaccaccatggcctgggctctgctcctcctcaccctcctcactcaggcacagggtcctgggcccagtctgccctgactcagccctccctccgcgtccgggtctcctggacagtcagtcacatcctctgcactggaaccagcagtgacgttggtacgttaataactatgtctctgaccaacaaaacnccagacaaacncccaaatcatattangagtcactagcgcctgacgggtccngactcgcttcctctcgcctacaggtctcgcaaccgaccggccctcccgtcgaccgtctcgtcgggcctccggaggtctaggaggtatggagtcgtagtactttattattcgacgtacgtctacgtatagtcgacgtaaggtactaaggtttaacagtaggttagaagtttacgggttacggggacgggaacggtaaacccgtaacgttccggttacccgttaccgttaacgggtaccgaaccggtaccccggaacggttccccgttcccggttcccccgttaaccggg

SEQ ID NO: 323665 - DNA, 383 bp, Homo sapiens
  misc_feature: GZ8MTXP01D2IM2.4.39.D06.1.454.CMB.2.raw
  modified_base (376)..(383): a, c, t, g, unknown or other
  misc_feature (376)..(383): n is a, c, g, or t
tcagagcactgtagcacgaccggtgctcgatttagtgacatctcgcagttctttgggggctaaaaaggaaggtccccaagaccctgtggcctggagtgggttgatatggaacagtgggcggactagtggggcagggcagccttggagttacaagtgaatcccaaggccttggaacaggcagcaacctatggggtatgtgaagcccagaggggtatggtttgggagggagatcgtgagtgtgtgtgaaaaggggtgctgtctctaaggattggagcagtgggagtgcgagacccaagttaagagtccgagatcgcaagagttaagagacctagaagaactgggtggtggaggcgggctgggcaaaggcgacagtagnnnnnnnn

SEQ ID NO: 323666 - DNA, 636 bp, Homo sapiens
  misc_feature: GZ8MTXP01E0DHY.4.39.D06.1.454.CMB.2.raw
  modified_base (230)..(230): a, c, t, g, unknown or other
  misc_feature (230)..(230): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcttatactatgtctctgaccaacaacaccagacaaacgtcccaaattcattaattatgagtcaactaacgcgccctcgtacggggtccctgacttcgtcttccctctcgtcccgtaccgaaggtcctggaaccaaaccgaccgtccccttccctcggtaccctcgtcgtacgggcctaccgaggcgtaggaggtagtggacggtactaggtatttaacgtttacgttacggctaacggtccttaatacttagtcgacggtaggtaccgtaagtttaccgaagttggtagtaagttacgttacgggggaccggttaacggggaaacctaaacggcgttccgttacgtcgggtacaaccggtacccgacggttccgtaacccgttcccccgtcg

SEQ ID NO: 323667 - DNA, 553 bp, Homo sapiens
  misc_feature: GZ8MTXP01DJ06P.4.39.D06.1.454.CMB.2.raw
  modified_base (231)..(231): a, c, t, g, unknown or other
  misc_feature (231)..(231): n is a, c, g, or t
  modified_base (302)..(302): a, c, t, g, unknown or other
  misc_feature (302)..(302): n is a, c, g, or t
  modified_base (385)..(385): a, c, t, g, unknown or other
  misc_feature (385)..(385): n is a, c, g, or t
  modified_base (447)..(447): a, c, t, g, unknown or other
  misc_feature (447)..(447): n is a, c, g, or t
tcagagcactgtagcacgaccggtgctcgatttagtgacatctcgcagttcgtttggggggggtctcaggaggcagcgctctcaggacgtcaccaccatggcctgggctctgctcctcctcaccctcctcactcagggcacagggtcctgggcccagtctgccctgactcagccctccctcggcgtccgggtctcctggacagtcagtcaccatctcctgcactggaaccngcagtgacgttggtcttataactatgtctctgaccaaacaacaccagacaaacgccccaaatcataattangagtacactaagcgccctcgacgggtccctgatcgcttccctctcgcctacaaggctaggccaaaccgaccggtcccttcccncgtaccgtctcgtcgggctccgaggctaggaggatgaggtctagtattatattgcagtctanatatgacaggactagttacaagtgtgaattagttcgggacggaagggtaaccaaacgttcgaccgttactgggtacaacgtacccgagttcctcgttccccgtcgg

SEQ ID NO: 323668 - DNA, 613 bp, Homo sapiens
  misc_feature: GZ8MTXP01A9FRV.4.39.D06.1.454.CMB.2.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (329)..(329): a, c, t, g, unknown or other
  misc_feature (329)..(329): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctccgtggacagtcagtcaccatcctcctgcactggaaccngcagtgacgttggtcttataactntgtctcngaccaacacnccagcaacncccaatcatatngagcanagcgcctgacgggtcctgactcgtcttcccnctcgaccctcgaaggctacggccaacgacccggtccctcccgtcgacccgttcgtcgtcgggtcctcgaggctaggaggtactgggacgtacgttagtaatttactttagttcgacgtacgtctttacgaatttacgcgacgtacggtacgttacgttaagtaagttggtaagtaagttacggttcgggggaacggttacgggtaaacctaacggttccggaccgttacgtaacgggcaaccgggtacccgaacgggttcccttcccggttaaccccgtttccg

SEQ ID NO: 323669 - DNA, 524 bp, Homo sapiens
  misc_feature: GZ8MTXP01DRFNK.4.39.D06.1.454.CMB.2.raw
  modified_base (230)..(230): a, c, t, g, unknown or other
  misc_feature (230)..(230): n is a, c, g, or t
  modified_base (297)..(297): a, c, t, g, unknown or other
  misc_feature (297)..(297): n is a, c, g, or t
  modified_base (335)..(335): a, c, t, g, unknown or other
  misc_feature (335)..(335): n is a, c, g, or t
  modified_base (397)..(397): a, c, t, g, unknown or other
  misc_feature (397)..(397): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (501)..(501): a, c, t, g, unknown or other
  misc_feature (501)..(501): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacgagggtcctgggcccagtctgccctgactcagccctccctccgcgtccggtctcctggacagtcagtccacatctcctgcactggaaccngcagtgacgttgtcttaatactatgtctctgaccaacacaccagacaaacgccccaatcaatattangagtcactagcgccctgacggtcctgactcgtcttccnctcgcctaccgagctcgccaaacgtccgccctaccgtcgaccgtctcgtgctcgagctgagngtgagctgattatntcgacncgtntcattancgagagtactaagttactaagtgtaagtaatggttcggaacggagaaacctaagcgttaccgttctaaggacnccgaccagccgtcccgcccgtcg

SEQ ID NO: 323670 - DNA, 706 bp, Homo sapiens
  misc_feature: GZ8MTXP01CNUVF.4.39.D06.1.454.CMB.2.raw
  modified_base (233)..(233): a, c, t, g, unknown or other
  misc_feature (233)..(233): n is a, c, g, or t
tcagagcactgtagcacgaccggtgctcgatttagtgacatctcgcagttcgtttgggggggggtctcaggaggcagcgctctcaggacgtcaccaccatggcctgggctctgctcctcctcaccctcctcactcagggcacgagggtcctgggcccagtctcgccctgactcagccctccctccgcgtccggtctccgtggacagtcagtcacatcctctgcacgtgaaccngcagtgtacgttggtacgttaatactatcgtctctacgaaccaaacaaccaccaaggaccaaaacgacccctaaattcaattaattatagagtacaacgtaacggccgtacccgttaggaccgggggtcccttagacttccgtctttccccgtaccgtcgtccctacgaaggtccgtacggaacctaaaccgtacccggtcccttcccgtcgtacccgtctcggtcgggtcctacggacggtcgtaggaggtagtacgggagtcgttagttatttaagttacgttcgacgtagtcctacgtaagtacgtcgaccggtagtaaccgtaagtttaagaagttgtagtaagttaccgggttacggggaaccggaacgggtaaaaccctaggttacccggttacccggttacgttaaaccggtaccgaaccggaacccgtaacggttccccgtaacccggttcccccgtttaacccg

SEQ ID NO: 323671 - DNA, 589 bp, Homo sapiens
  misc_feature: GZ8MTXP01B99OV.4.39.D06.1.454.CMB.2.raw
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcacatctctgcactggaaccagcagtgacgttggtcgttatactatgtctctgacaacacaccagacaacnccccaatcatattangagtcactagcgtccctcgacgggtcctgactcgtcttcctctcgccctaccgaaggcgtcggccaaaccgtacccggcccttccccgtcgtaccccgttcgtccgtcggggtcctcccgacgggtctgggaggtagtgggacggtcgtagtatttaattagttcgcgtagtcttactagtatcgcgaggtactagttactagttgtgtaagttacgttcgggtacggaacggtaaccgtaagttccgttaccgttccgtaaggtcctaacgacccgacgttcctccgccccgttcg

SEQ ID NO: 323672 - DNA, 577 bp, Homo sapiens
  misc_feature: GZ8MTXP01BQDXW.4.39.D06.1.454.CMB.2.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (299)..(299): a, c, t, g, unknown or other
  misc_feature (299)..(299): n is a, c, g, or t
  modified_base (415)..(415): a, c, t, g, unknown or other
  misc_feature (415)..(415): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggaaccngcagtgacgttggtcttanaactatgtctctgaccaacaacaccagacaaacgccccaaattcaatattangagtcaactaagcgtccctgacggggtcctgatcgcttcctctcgcctcaaggctgcaacacgcctcctgcctctcgtcggctccgaggctgagatcgagtctagattattagttncggaagtctacagttagcgcgaaggtactaaggttaactaagtcgtagtaagttacgttcgggaaccgggaacgggtaaacctaaaacggttcggttaacccgttcgtaacggtccgaacggtaccccgaagggttccctcccggttccccgtttaacccgg

SEQ ID NO: 323673 - DNA, 552 bp, Homo sapiens
  misc_feature: GZ8MTXP01ARCYU.4.39.D06.1.454.CMB.2.raw
  modified_base (255)..(255): a, c, t, g, unknown or other
  misc_feature (255)..(255): n is a, c, g, or t
  modified_base (297)..(298): a, c, t, g, unknown or other
  misc_feature (297)..(298): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (322)..(322): a, c, t, g, unknown or other
  misc_feature (322)..(322): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
  modified_base (443)..(443): a, c, t, g, unknown or other
  misc_feature (443)..(443): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtcccgggtctcctggacagtcagtcaccatcctcctgcactggaaccagcagtgacgttggtcttatactntgtctctgaccaacaacaccagcaaacgccccaatcatattnnagtacanagcgccncgagggtccngctcgctcnctcnctcagctcgcacnccgcctaccgtcgaccgtctcgtcggctccgaggtctacggaggtatggacggtctaggttattattagttcgacggtagtctaccgagttacgngaccgagtacctagtttacagtgttgaacttcggttcgggacggttacggaacctaagttccggaccttcgtaaggccaacgtccgaggcctaaccgccccgttaacgg

SEQ ID NO: 323674 - DNA, 609 bp, Homo sapiens
  misc_feature: GZ8MTXP01DOC00.4.39.D06.1.454.CMB.2.raw
  modified_base (226)..(226): a, c, t, g, unknown or other
  misc_feature (226)..(226): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
  modified_base (459)..(459): a, c, t, g, unknown or other
  misc_feature (459)..(459): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcacatctctgcactgaaccngcagtgacgttggtcttaatatatgtctctgaccaacaacaccagcaaacnccccaatcaataattangagtcaactagcgcctgacgggtcctgtactcgtcttccactcgcccgtacaaggctacgcaaaccgaccggtccctaccctgcccgttcgtcgtggggtccctacgagggctaggacggaagttggagtcgttagtaatttattacgttgctaacggtccttanagtttaagtcgacgtacgtaactagttaacgtaagtggtagtaacgttagggttcgggaaccgggttaacggtaaacctacggttaccggttacccgttaccggtaacgaccgaaccggtacccgacggttccgtccccgttccccgtcg

SEQ ID NO: 323675 - DNA, 624 bp, Homo sapiens
  misc_feature: GZ8MTXP01DFX7V.4.39.D06.1.454.CMB.2.raw
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
tcagagcactgtagcacgaccggtgctcgatttagtgacatctcgcagttcgtttgggggggggtctcaggaggcagcgctctcaggacgtcaccaccatggcctgggctctgctcctcctccaccctcctcactcagggcacagggtcctgggcccagtctcgccctgactcagccctccctccgcgtccggtctcctggacagtcagtcacatctctgcactaggaaccngcagtgacgttggtcttaatactntgtctctgacaacacaccagcaaacncccaaattcaatattangagtcactacgccgccctgacgggtcctgactcgcttccnctacgcctaccgaagtcctaggccaaacgcccgggtcccttcccgtcgtacccgtctccggtcggtcctaccgagggtcgtagggaaggaagtcgggaggtaccttaggttaatttagttaagttcggactaacggtcttaccaagtttcgacgcggtagtaaccgtagttaactaagtggtataacgttaggttccggggacggaaacggtaacctaacgttacggttccgttacgtaacggacaaccggccgtacggttcctaacccggttccccgttaacgg

SEQ ID NO: 323676 - DNA, 528 bp, Homo sapiens
  misc_feature: GZ8MTXP01C741C.4.39.D06.1.454.CMB.2.raw
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (430)..(430): a, c, t, g, unknown or other
  misc_feature (430)..(430): n is a, c, g, or t
  modified_base (433)..(434): a, c, t, g, unknown or other
  misc_feature (433)..(434): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcaggcacagggtcctgggcccagtctgccctgactcagccctccctccgcgtccgggtctcctggacagtcagtcacatctctgcactggaaccagcagtgacgttggtcttaataactatgtctcctggaccaacaacacccaggacaaagcccccaaattcaataatttangaggtcaactaagcggccctnagggggtccctgatcgcttcctctagcctccaaaggctgggcaaacacggcctacccgtgacccgtctctgggactccaggcgngagangaggntatatatatncgnntananangngaganatanatatgtaagtagttggacggacggaacgaacacgacgttaccgtaagtacgaacgaccgacgcgtccgcccgtccg

SEQ ID NO: 323677 - DNA, 512 bp, Homo sapiens
  misc_feature: GZ8MTXP01C5Z8I.4.39.D06.1.454.CMB.2.raw
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
  modified_base (295)..(295): a, c, t, g, unknown or other
  misc_feature (295)..(295): n is a, c, g, or t
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
tcagagcactgtagcacgaccggtgctcgatttagtgacatctcgcagttcgtttggggggggtctcaggaggcagcgctctcaggacgtcaccaccatggcctgggctctgctcctcctcaccctcctcactcagggcacagggtcctgggcccagtctgccctgactcagccctccctcgcgtccggtctcctggacagtcagtcaccntctctgcactggaaccngcagtgacgttggtcttataactatgtctctgaaccaacacaccagacaaacgccccaatcatattngagtcatagcgcctcgaggtcctgatcgcttccnctgcctcagctgcaacncgcctccctgactctctgggctccgagctgaggatgagctgtattattagtgagacgctacatatgcgaggactagttactaatgtgtaatgttcgggacggacggaaacctaacgttacgccgttccgtaacggtcaacgacccgaggcctccgccccgttccgg

SEQ ID NO: 323678 - DNA, 573 bp, Homo sapiens
  misc_feature: GZ8MTXP01CFB5C.4.39.D06.1.454.CMB.2.raw
  modified_base (230)..(230): a, c, t, g, unknown or other
  misc_feature (230)..(230): n is a, c, g, or t
  modified_base (297)..(297): a, c, t, g, unknown or other
  misc_feature (297)..(297): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcttatactatgtctctgacaacacaccagacaaacgccccaaatcataattangagtcactaagccgccctcgacgggtccctgactcgtctttcctctgccctaccaaggctcggcaacgaccgggccctcctcgaccgtctcgtcgggctccgaggctgagatgaggctgattattactgctagctcgtatactgcgaggctagttaaccagttgtagtaacgttagttcgggacgggaacgggtaaccctaagttccgttacccggttaccgttaacggtccaaccggtcccgaacggttccgttaaccccgcccccgtttccggg

SEQ ID NO: 323679 - DNA, 684 bp, Homo sapiens
  misc_feature: GZ8MTXP01DO9HF.4.39.D06.1.454.CMB.2.raw
  modified_base (323)..(323): a, c, t, g, unknown or other
  misc_feature (323)..(323): n is a, c, g, or t
  modified_base (558)..(558): a, c, t, g, unknown or other
  misc_feature (558)..(558): n is a, c, g, or t
tcagagcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagccctccctccgcgtccaggtctccgtggacagtcagtcaccatctcctgcacgtggaaccagctagtgacgttggtacgttataactatgtctccgtagtaccaacaacaacccaggaccaaaccgccccctaaattaccaattaatttanaggtagtacaacgtaaacgcccggtccctacggacggggttcccctaggactccgtccttcctctcgccctacccgaaagggtcctcggacccgtaaaccgacccgggtcccctccccgtacgtacccgtctcgtcgggccctcggaggtcgtacggaggtatgggaagtccgttagtaactttattacgttgggactagccttagtattaagcgtagacggtactacggttaanagttggtaaggtagttacgggttacgggacgggtaaaccggtacttaaacggttcgggttaaacccgttccgttaaacggggctaaccgggaccccgttaacgggtcccgttcccggttccccccg

SEQ ID NO: 323680 - DNA, 556 bp, Homo sapiens
  misc_feature: GZ8MTXP01BVJ3G.4.39.D06.1.454.CMB.2.raw
  modified_base (228)..(228): a, c, t, g, unknown or other
  misc_feature (228)..(228): n is a, c, g, or t
tcagagcactgtagcacgaccggtgctcgatttagtgacatctcggcagttctttgggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggaaccngcagtgacgttggtcgttataactatgtctctgaccaacaacaccagcaaagccccaaatcataattatgagtcactaagcggccctcgacgggtccctgatcgtctttccgctgccctaccaaggcctggcaaacgacccggcctcccctgaccgtctcgtgggctccgaggctgaggatgagctgattagtattgcagtcttcatatcgcgaggactagttaccaagttgtggaattaagttccggacgggttacgggaacctaaacgttcgaccggttcctaacgggtccaacgaccccgaagggccctcgttccccccgtaagg

SEQ ID NO: 323681 - DNA, 637 bp, Homo sapiens
  misc_feature: GZ8MTXP01AZWFU.4.39.D06.1.454.CMB.2.raw
  modified_base (330)..(330): a, c, t, g, unknown or other
  misc_feature (330)..(330): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
  modified_base (472)..(472): a, c, t, g, unknown or other
  misc_feature (472)..(472): n is a, c, g, or t
  modified_base (479)..(479): a, c, t, g, unknown or other
  misc_feature (479)..(479): n is a, c, g, or t
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
  modified_base (528)..(528): a, c, t, g, unknown or other
  misc_feature (528)..(528): n is a, c, g, or t
tcagagcactgtagcacgaccggtgctcgatttagtgacatctcgcagttcgtttgggggggggtctcaggaggcagcgctctcaggacgtcaccaccatggcctgggctctgctcctcctcaccctcctcactcagggcacgacgggtcctgggcccagtctcgccctgactcacgtcctcccgtccgcggtcccgggtctccgtggactagtcacgtccaacctatcctcctgacacgtacggaaccagctagtcgtacgttggtacttaataactatgtctcgtagaaccaacaacaccagaacaaacgaccctaatcaataattanagacgtacacgtacgccgccctagtacgggtcctgacttccgcttcccctactcgtacccgtacgaacgtcgtacgaacaaccgtacccggcccttccgacgtccggtctcgtacggtccacggnggtacgnggagtacggngtacgtntagttattagtcgtgacgtcgtactanagtcgngacgagtactagtaanagtgtaagtgttacggacggggaacggaacgtaaaccgtaacgttaccggttccgttacggtaacgtacgaacccgtaccggtccggcccgttaacccgttcccgtaag

SEQ ID NO: 323682 - DNA, 537 bp, Homo sapiens
  misc_feature: GZ8MTXP01EBD2O.4.39.D06.1.454.CMB.2.raw
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
tcagagcactgtagcacgaccggtgctcgatttagtgacatctcgcagttctttggggggggtctcaggaggcagcgctctcaggacgtcaccaccatggcctggctctgctcctcctcaccctcctcactcaggcacgagggtcctgggcccagtctgccctgactcagccctcctccgcgtccggtctcctggacagtcagtcaccatctcctgcactggaaccngcagtgacgttggtacttatactatgtctctgaccaanaacnccagcaaacgccccaaatcatattatgagtcaatagcgccctcgagggtcctgatcgcttcnctncctcgagcngctacgacgcctcctgccgtctcgtcggctccgagctgagagtgagctgtaagttattatggcagtctanatanganggtaactagttaacaagttggtntaaagtcggttacgggcgggttaaagggaaacctaaacgttcgttacccgttacgtgaccgtcgaccccgaggttcctcccgttccccgttccg

SEQ ID NO: 323683 - DNA, 607 bp, Homo sapiens
  misc_feature: GZ8MTXP01E1GDX.4.39.D06.1.454.CMB.2.raw
  modified_base (315)..(315): a, c, t, g, unknown or other
  misc_feature (315)..(315): n is a, c, g, or t
  modified_base (423)..(423): a, c, t, g, unknown or other
  misc_feature (423)..(423): n is a, c, g, or t
tcagagcactgtagcacgaccggtgctcgatttagtgacatctcgcagttctttggggggggggtctcaggaggcagcgctctcaggacgtcaccaccatggcctgggctctgctcctcctcaccctcctcactcagggcacagggtcctgggcccagtctgccctgactcagccctccctccgcgtcccgggtctcctggacagtcagtcaccatctcctgcactggaaccagcagtgtacgttggtcttataactatgtctcctggaaccaaacaaccaccaggacaaacgcccccaaattcaataaatttangagtcaactaacgcgccctgacggggtccctgatccgcttcctctcgccctcgaaggctggcaaacgaccggccctccctgaccgtctcgtggctccgaggctgagancgagctagtattaattattagcgtaagtctagaatatcggactagggactaacggttaacaaagttgtgtaacgttagttacgggggcgggaaacgggaaaccctaaaacgccggttaaccccgttccgtaagggacccaacggccccgaagggccctaacccggttcccccccgttaaccggg

SEQ ID NO: 323684 - DNA, 513 bp, Homo sapiens
  misc_feature: GZ8MTXP02HUE2T.4.39.D06.1.454.CMB.2.raw
  modified_base (226)..(226): a, c, t, g, unknown or other
  misc_feature (226)..(226): n is a, c, g, or t
  modified_base (297)..(297): a, c, t, g, unknown or other
  misc_feature (297)..(297): n is a, c, g, or t
tcagagcactgtagcacgaccggtgctcgatttagtgacatctcgcagttctttgggggtctcaggaggcagcgctctcaggacgtcaccaccatggcctgggctctgctcctcctcaccctcctcactcagggcacagggtcctgggcccagtctgccctgactcagccctccctcgcgtccgggtctcctggacagtcagtcaccatctcctgcactggaaccngcagtgacgttggcttataactatgtctctgtaccaacaacacccagcaaacgccccaaattcataattangagtcactaagcgccctcgaggggtccctgatgcttcctctgcctcagctggcaacacggccctccctgaccgtctcgtcgggctccgaggctgagatgaggctgattattattgcagtctcatatgcaggcagttacaagtgtagtatagttcggacggacggaaccaaacgtcgaaccgtcctaaggtcacgacccaaggcctcgcccccgtcg

SEQ ID NO: 323685 - DNA, 533 bp, Homo sapiens
  misc_feature: GZ8MTXP02GCE6O.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctgtaccaacaacacccagcaaagcccccaaatcataatttatgagtcactaagcggccctcacgggtccctgatcgcttcctctcgcctccaaggctggcaacacggcctccctcgaccgtctctgggctccgagctgagatgagctgattattattgcagctcatatgcaggctaagttacaagttgtagtattagttcgggacggacgggaaccaaaacgtacgacccgttccgtaaggtcaacgccccgaaggtctccgcccccgttcgg

SEQ ID NO: 323686 - DNA, 547 bp, Homo sapiens
  misc_feature: GZ8MTXP02FXRL2.4.39.D06.1.454.CMB.2.raw
  modified_base (303)..(303): a, c, t, g, unknown or other
  misc_feature (303)..(303): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacaacacccaggcaaagcccccaaatcataatttangagtcactaagcggccctcaggggtccctgatcgcttcctctgcctcaaggctggcaacacggcctccctgaccgtctctgggctccagctgagatgagctgattattattgctagctcatatgcaggctagttacaatgtgtatagttcgggacggaacggggaacctaaacgttacggacccgttaccgtaacgggtccaacggacccccgaaagggtccttaccggccccccgtttccggg

SEQ ID NO: 323687 - DNA, 524 bp, Homo sapiens
  misc_feature: GZ8MTXP02IYRZL.4.39.D06.1.454.CMB.2.raw
  modified_base (305)..(305): a, c, t, g, unknown or other
  misc_feature (305)..(305): n is a, c, g, or t
  modified_base (425)..(425): a, c, t, g, unknown or other
  misc_feature (425)..(425): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctggtaccaacaacacccaggcaaacgccccaaatcataatttangagtcactaagcggccctgacgggtccctgatcgcttcctctgcctccaagctggcaacacggcctccctgaccgtctctgggctccgaggctgagatgaggctgattattattgcagtntcatatgcaggcagttacaatgtgatagttcggcggaagggacctaaaacgtcgaacccgttcgtaaggtcacgccccgaaggcctacgcccccttcgg

SEQ ID NO: 323688 - DNA, 522 bp, Homo sapiens
  misc_feature: GZ8MTXP02J3CVC.4.39.D06.1.454.CMB.2.raw
  modified_base (427)..(427): a, c, t, g, unknown or other
  misc_feature (427)..(427): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgtttggtcgttataactatgtctcctggtaccaacaacacccagcaaagcccccaaattcataatttatgagtcactaagcgccctcagggtccctgatcgcttcctctgcctcaagctggcaacacggcctcctgaccgtctctgggcctccaggctgagatgaggctgattattattgcagctcattangcgagctagttacagtgtagtagtagtcggacggaacggaaccaacgtacgtaccgtacgtaacgacgacgacccgaacggcctccgccccgtcg

SEQ ID NO: 323689 - DNA, 715 bp, Homo sapiens
  misc_feature: GZ8MTXP02H79U7.4.39.D06.1.454.CMB.2.raw
  modified_base (306)..(306): a, c, t, g, unknown or other
  misc_feature (306)..(306): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctggtaccaacaacacccaggcaaacgccccaaatcaataatttangagtcactaagcggccctcgagggtccctgactcgcttcctctcgcctccaagcttggcaaccgaccggccctcccgtcgacccgtcttccgtcggggcctcccgacgggtcctagggaaggtaacgttgggaacgggtccgttagggtaaattttaatttaagttttcggaccgtaacggttccgttacctaaacgttaagttcgggtacccgaaagggggtaccctaaagggtttttaaaccaaaaggtttcggttaaacggtaagttttaacgggtttcccgggggtacggggaaaacgggggtaacccctaaaaacggttccggttaaccccggttacccgttaaaggggttcccaaacgggacccccgaaagggtcccgtaccggtacccccccgtttaccggg

SEQ ID NO: 323690 - DNA, 521 bp, Homo sapiens
  misc_feature: GZ8MTXP02I5U3J.4.39.D06.1.454.CMB.2.raw
  modified_base (302)..(302): a, c, t, g, unknown or other
  misc_feature (302)..(302): n is a, c, g, or t
tcagagcactgtagcacgaccggtgctcgatttagtgacatctcgcagttctttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctctggtaccaacaacacccagcaaacgccccaaattcataatttangagtcactaagcgccctcaggggtccctgatcgcttcctctgcctcaagctggcaacacggccctccctgacccgtctctgggcctccaggctgaggatgagatgattattattgcagctcatatgcaggcagttacaagtgtagattagttcggacggagggaaccaaacgtcggaaccgtccgtaaggtcaacgcccaaggccttcgaccccctcgg

SEQ ID NO: 323691 - DNA, 512 bp, Homo sapiens
  misc_feature: GZ8MTXP02HPMQG.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctggtaccaacaacacccagcaaacgccccaaatcataatttatgagtcactaagcgccctcagggtccctgatcgcttcctctcgcctccaagctggcaacacggcctccctgaccgtctctggctccgagctgagatgaggatgattattattgcagctcatatgcaggctagttacaatgtagatagttcggacggacgggaacaaacgtcgaccgtctaaggtcacgtcccaagcctacgccccgtcg

SEQ ID NO: 323692 - DNA, 547 bp, Homo sapiens
  misc_feature: GZ8MTXP02IYHPI.4.39.D06.1.454.CMB.2.raw
  modified_base (302)..(302): a, c, t, g, unknown or other
  misc_feature (302)..(302): n is a, c, g, or t
  modified_base (372)..(372): a, c, t, g, unknown or other
  misc_feature (372)..(372): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctgtaccaacaacaccagcaaacgccccaaattcataatttangagtcactaagcggccctcgagggtccctgatcgcttcctctgcctccaagctggcaacacggcctcccngaccgtctcgtggctccagctgagatgagctgattattatgtacagtctacatatgcaggcaagttacaagtgtagtactagttcgggacggtaacgggaacctaaacgtacgtaacccgtaccgttaacgggtaccacggacccgaaacggtccgtaccgtacccccgttccgg

SEQ ID NO: 323693 - DNA, 506 bp, Homo sapiens
  misc_feature: GZ8MTXP02F4ZUT.4.39.D06.1.454.CMB.2.raw
tcagagcactgtagcacgaccggtgctcgatttagtgacatctcgcagttctttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgtttggtcgttataactatgtctcctggtaccaacaacacccaggcaaagcccccaaatcataatttatgagtcactaagcgccctcaggggtccctgatgcttcctctgcctccaaggctggcaacacggcctcccctgacccgtctctgggctccaggctgagatgagctgattattattgcagctcatatgcaggcagttacaatgtgatagttcggcggaagggacaaacgtcgaccgtctaaggtcagacccaaggctcgcccctcg

SEQ ID NO: 323694 - DNA, 539 bp, Homo sapiens
  misc_feature: GZ8MTXP02GRLZZ.4.39.D06.1.454.CMB.2.raw
  modified_base (453)..(453): a, c, t, g, unknown or other
  misc_feature (453)..(453): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagcaaagccccaaattcataattatgagtcactaagcgccctcaggggtccctgatcgcttcctctgcctccaaggctgggcaacacggccctcccgtgaccgtctcgtcgggctcccgaggctggagatgaggctagtattagttattgcagtctcatactgcaggctagttaanagtgtatagtacgtcgggacggaacggaaactaacgtacgtaccgtacgtaacggtcgaacgaccgaggccgtaccgtccccgtcg

SEQ ID NO: 323695 - DNA, 519 bp, Homo sapiens
  misc_feature: GZ8MTXP02H7LHO.4.39.D06.1.454.CMB.2.raw
  modified_base (305)..(305): a, c, t, g, unknown or other
  misc_feature (305)..(305): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctggtaccaacaacacccaggcaaagcccccaaattcataatttangaggtcactaaagcggccctcgaggggtcccctgatcgcttcctctcgcctccaaggctggcaacacggcctccctgaccgtctctgggctccaggctgagatgaggctgattattattgcagctcatatgcaggcaagttacaagtgttagatagttcggcggaagggaccaaaactcgaccgtcgtaagcacgccaaggctcgacccctcgg

SEQ ID NO: 323696 - DNA, 551 bp, Homo sapiens
  misc_feature: GZ8MTXP02IETN1.4.39.D06.1.454.CMB.2.raw
  modified_base (307)..(307): a, c, t, g, unknown or other
  misc_feature (307)..(307): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctcgcgtccgggtctcctggacagtcagtcaccatctcctgcactggaaccagcagtgacgttggtcgttataactatgtctcctggtaccaacaacacccaggcaaacgcccccaaattcataaatttangaggtcactaagcggccctcaggggtccctgatcgcttccctctcgcctccaaggctggcaacacggcctcccctcgaccgtctcgtgggctccgaggctcggagatggagctgattattattgcagtctcatatgacaggcagtttacaatgtagattaagttcgggacgtaaaggggaaccctaaaacgtcggtaacccgtaccgtaaggtcaacgcccgtaaaggcctacgcccccttcgg

SEQ ID NO: 323697 - DNA, 552 bp, Homo sapiens
  misc_feature: GZ8MTXP02G8OKI.4.39.D06.1.454.CMB.2.raw
  modified_base (301)..(301): a, c, t, g, unknown or other
  misc_feature (301)..(301): n is a, c, g, or t
  modified_base (375)..(375): a, c, t, g, unknown or other
  misc_feature (375)..(375): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagcaaagccccaaatcataattangagtcactaagcgccctcgacggggtccctgatcgcttcctctcgcctccaaggctggcaacgacggcctcccngaccgtctcgtgggctccgaggctgagatgagtctgattattattgcagtctacatatgcgaggtctagttaacaagtgtagtatagttcgggacggaagggtaaaccaaacgtcggaacccgttacgtaacgggtccaacggtaccccgaaaggtccgtaccgacccccgttccgg

SEQ ID NO: 323698 - DNA, 536 bp, Homo sapiens
  misc_feature: GZ8MTXP02G4AAI.4.39.D06.1.454.CMB.2.raw
  modified_base (388)..(388): a, c, t, g, unknown or other
  misc_feature (388)..(388): n is a, c, g, or t
  modified_base (405)..(405): a, c, t, g, unknown or other
  misc_feature (405)..(405): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (431)..(432): a, c, t, g, unknown or other
  misc_feature (431)..(432): n is a, c, g, or t
  modified_base (441)..(445): a, c, t, g, unknown or other
  misc_feature (441)..(445): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (455)..(455): a, c, t, g, unknown or other
  misc_feature (455)..(455): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccaggtctcctggacagtcagtcaccatctcctgcactggaaaccagcagtgacgttggtcgttataactatgtctcctggtaaccaacaaacaccccaaggacaaacgaccccccaaaatttccaataaatttatgaaggtacaactaaagcggccctcgaggggtcccctgactcgccttctctgcctccaagctggcaaacncggcctcctgaccgtcnctgggcctccgaggctgaggangngnntatattatnnnnnananagnagngagtaataatagtagtagtagtcggacggacggaacgaacgtacgacgtaacgtacgtacgacgaccgacgacgccgcccg

SEQ ID NO: 323699 - DNA, 533 bp, Homo sapiens
  misc_feature: GZ8MTXP02F3KB1.4.39.D06.1.454.CMB.2.raw
  modified_base (307)..(307): a, c, t, g, unknown or other
  misc_feature (307)..(307): n is a, c, g, or t
  modified_base (415)..(415): a, c, t, g, unknown or other
  misc_feature (415)..(415): n is a, c, g, or t
  modified_base (522)..(522): a, c, t, g, unknown or other
  misc_feature (522)..(522): n is a, c, g, or t
tcagagcactgtagcacgaccggtgctcgatttagtgacatctcgcagttctttggggagctctgggagaggagccccagccctgagattcccacgtgtttccattcagtgatcagcactgaacacagaggactcgccatggagtttgggctgagctgggttttccttgttgctatttaaaggtgtccaatgtgaggtgcaactggtggagtcgtgggggaagtgtggtacggccgtgggggtccctgagactctcctgtacagcctctggattctcctttgatgattatggcatgagctgggtccnccaagcctccgaaggggaggggctgggagtgggtgtcgtggtatgaattggagtggcggtagtacaggcttatgcagactctggtgaagggccattcacatcacaganacaaacgccaaagacctcctgtatctcgacaattgaaactggtctagacgagcccgaggacacggtcttgtaacttacgtgtaagcgaagtaacgtagtttaggggngttagtaacgg

SEQ ID NO: 323700 - DNA, 586 bp, Homo sapiens
  misc_feature: GZ8MTXP02F2RAN.4.39.D06.1.454.CMB.2.raw
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
tcagagcactgtagcacgaccggtgctcgatttagtgacatctcgcagttctttgggttttgggggaagtgtggtacggcctgggggtccctgagactctcctgtacagcctctggattctcctttgatgattatggcatgagctgggtccgccaagctccagggaaggggctggagtgggtgtctggtatgaattggagtggcggtagtacagcttatgcagactctgtgaagggccattcaccatctccagagacaacgccaaagaactccctgtatctgcaattgaacagtctgagagccgaggacacggcctttgtattactgtgcgagaactagtttaggggntgtagtggtaaacngtctgcttagttcgtcgtagtttgggttagtacgtacgtcggggccgagggcgtcccgtcggtccaccgtctcctcacgccctacccaccgacggccctacgtccggttcccttcccccgcggcccgcccgtcgcctccgacggaccgaccacccgaccgacgacgaccgacgacggcccggtccggtcggcgtcggtccgtacggtacgaacgtaccttaccg

SEQ ID NO: 323701 - DNA, 570 bp, Homo sapiens
  misc_feature: GZ8MTXP02G3EKN.4.39.D06.1.454.CMB.2.raw
  modified_base (227)..(227): a, c, t, g, unknown or other
  misc_feature (227)..(227): n is a, c, g, or t
  modified_base (408)..(408): a, c, t, g, unknown or other
  misc_feature (408)..(408): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgtttggtcgttataactatgtctcctggtaccaacaacacccaggcaaagcccccaaaattcataatttatgagtcactaagcggccctcaggggtccctgatcgcttcctctgcctcaaggctggcaacacggcctcctgaccgtctcggcgtccacgcgtcgagagtaggngacgtagtagttattagttagtacgtacgtactactatagtagacgacgacgtacgttaacgtaagtagtagtagtacgttacggacgggaacggaaccgtaaactacgtaccgtaccgtacgtaacgacgaccgtacgaccgtccgtaccccgtaccgtcg

SEQ ID NO: 323702 - DNA, 572 bp, Homo sapiens
  misc_feature: GZ8MTXP02HYEB0.4.39.D06.1.454.CMB.2.raw
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaaccagcagtgacgttggtcgttaataactatgtctctggtaccaaacaacacccaggacaaacgccccaaattcaataaatttangagtacactaagcgccctnacgggtcctgatcgcttccnctgcctcaaggctgcaacacgccctcctgaccgtctcgtcgggcctcccgagggcctaggaggaatggaaggtctagtatttaattagttgacagcttatatagtagacgagacgtaacgttaacgtaagtagtagtacgttagttacggtacggaacggaaaccgtaaacgtacgtaccgtaccgtaacgtacgacgaccgacgaccgtaccgtaccccgtccg

SEQ ID NO: 323703 - DNA, 559 bp, Homo sapiens
  misc_feature: GZ8MTXP02F68D3.4.39.D06.1.454.CMB.2.raw
  modified_base (302)..(302): a, c, t, g, unknown or other
  misc_feature (302)..(302): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacacacccaggacaaacgccccaaatcatattangagtcactaagcgccctcacggggtccctgatcgcttcctctcgcctcaggctcgggcaacaccggcctcccgtgacccgtctcgtcgggcctccgaggcctgacgatggagctgtattattattggctagtctacatagtcgacgtaggctagttaacaagtgtagattacgttcgggacggtagggaaaccctaaacgtacgacccgttaccgtaaggtacgacgacccgtaaggccttaccggcccccgttcgg

SEQ ID NO: 323704 - DNA, 565 bp, Homo sapiens
  misc_feature: GZ8MTXP02F0DKL.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacaccagcaaacgccccaaatcataattatgagtcactaagcgccctcgacggggtccctgatcgcttcctctcgcctccaaggctcgggcaaccgaccggccccctcgacccgtctcgtcgggcctccgaggctggaggatggacggtctagtatttattattgctagtctacatatgcgaggactaagttaacaagttgtagtattacgttcgggacggtaacgggaaccaaacgtcggacccgtcgtaacggtcgacgacccgaacggtcctccgcccccgttacggtccc

SEQ ID NO: 323705 - DNA, 548 bp, Homo sapiens
  misc_feature: GZ8MTXP02HM8VR.4.39.D06.1.454.CMB.2.raw
  modified_base (303)..(303): a, c, t, g, unknown or other
  misc_feature (303)..(303): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaaccagcagtgacgttggtcgttataactatgtctcctggtaccaacaacacccagacaaacgccccaaatcataatttangagtcactaagcgccctgacgggtccctagatcgcttcctctgcctcaaggctggcaacgacggcctccctgacccgtctccgtgggcctcccgagctggaggatggaggctgtattatattgcagtctcatactgacaggctaagttactaagtgtagattagttcgggacggacgggtaaccaaaacgcgtaacccgtcctaagggtccaacgcccgaaaggtcctaccgtacccccgttcgg

SEQ ID NO: 323706 - DNA, 499 bp, Homo sapiens
  misc_feature: GZ8MTXP02FS3PG.4.39.D06.1.454.CMB.2.raw
  modified_base (227)..(227): a, c, t, g, unknown or other
  misc_feature (227)..(227): n is a, c, g, or t
  modified_base (331)..(331): a, c, t, g, unknown or other
  misc_feature (331)..(331): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaacngcagtgagttggtcgttataactatgtctcctggtaccaacaacacccagacaaacgaccccaaattcataattatgagtcactaagcgccctcgagggtcccngatcgtctcctctgcctcaagctgcacacggcctccctgactctctgggctccgagctggagagtgaggctgattattattgcagctctatatgcgaggctatacgatgtgatagttcggcggaggacaactcgcgtctaaggtcacgaccgacgtcaccgcccctcg

SEQ ID NO: 323707 - DNA, 553 bp, Homo sapiens
  misc_feature: GZ8MTXP02FTVST.4.39.D06.1.454.CMB.2.raw
  modified_base (301)..(301): a, c, t, g, unknown or other
  misc_feature (301)..(301): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacaacaccaggcaaacgccccaaatcataattangagtcactaagcggccctcaggggtccctgatcgtcttcctctcgcctccaaggctcggcaacacggcctccctgaccgtctctgggctccagctgacgatgagctgattatagttgctagctcatatgacaggtcaagttacaagttgtgtacgttaagttcgggcgggaaacgggaacctaaaacgtcgaaacccggttccgtaaaggtccaaacggtaccccgaagggcctaccggtccccctttccgg

SEQ ID NO: 323708 - DNA, 599 bp, Homo sapiens
  misc_feature: GZ8MTXP02I4GYA.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctgtaccaacaacaccagacaaacgaccccaaattcaataatttatgagtacactaagcgccctcgagggtccctgattcgtcttcctctcgccctccaaggctaggcctaaaccgaccggccctcccgtgacccgtctcgtcgggcctccgaggcctggacggatggaggtctgtattattattcgactagtcttacattactgacgtaggctaagttacaagtgtagtataacgttcggggacgggtaaacgggaacctaaacgttaccggaacccgttaccggtaacggtaccacggtaccccgaaacgggtcctacccggtaccccccgttccggg

SEQ ID NO: 323709 - DNA, 545 bp, Homo sapiens
  misc_feature: GZ8MTXP02JCMD1.4.39.D06.1.454.CMB.2.raw
  modified_base (299)..(299): a, c, t, g, unknown or other
  misc_feature (299)..(299): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacaccagcaaagccccaaatcatattangagtcataagcgccctgacggggtccctgactcgcttcctctcgcctccaaggctggccaacaccggtccctccctgacccgtctcgtcgggcctccgaggctggacgatggagtctgattatattgactagctacatatcgacgaggtactagttacaagtgtagattacgttcgggacggacggaacctaacgtacgaccgtacgtaaggtaccacgtaccccgaagtcctaccgccccctcgg

SEQ ID NO: 323710 - DNA, 641 bp, Homo sapiens
  misc_feature: GZ8MTXP02GNAM7.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggacaaacgccccaaattcataattatgagtcactaagcggccctcgacggggtccctgatcgtcttcctctgcctccaaggctggcaacgaccggcctccctgacccgtctccgtggggcctccgaggctggacggatggaggtctagtatttatttagttgctagtctacaattatcgacgagggtactaaggtttaacaaagttggtagtaacgttacggtttaccgggggacgggaaacgggggtaaacccctaaaaccggtacggtaaccccggtttacccgtaaacgggggttacccaacccggggtacccccgaaaacggggtacccgttacccggtcccccccgtttaacccggg

SEQ ID NO: 323711 - DNA, 539 bp, Homo sapiens
  misc_feature: GZ8MTXP02IS1KC.4.39.D06.1.454.CMB.2.raw
  modified_base (384)..(384): a, c, t, g, unknown or other
  misc_feature (384)..(384): n is a, c, g, or t
  modified_base (430)..(430): a, c, t, g, unknown or other
  misc_feature (430)..(430): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggaaccagcagtgacgttggtcttataactatgtctctggtaccaacaacacccaggacaaacgcccccaaattcataatttatgagtcactaagcggccctcgacgggtccctgactcgcttcctctgcctcagctgcaacacgcctcctgaccgtctcncggctccagctgagatgagctgattattattgcagtctacattagngacgaggactaagttaacaagttgtagtacgttacgtcgggacggaacggtaaccaacgtacgaccgtacgtaacgtacgacgaccgaacgccgtacccgtccccgtcg

SEQ ID NO: 323712 - DNA, 560 bp, Homo sapiens
  misc_feature: GZ8MTXP02HR0Y6.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctctggtaccaacacaccagcaaacgccccaaattcataattatgagtcataagcgccctcgagggtccctgatcgcttcctctcgcctccgaagcctggccaacgaccggcctcccctgacccgtctcgtgggctccgagctgagatggaggtctgtattattattgactagtctactatatgacgaggtctagttaacaagtgtagtagttacgttcggggacggtaagggaaccctaaacgtcgtaaccgtacgtaacggtaccgacggacccgaaggtccctccggtacccccgttcgg

SEQ ID NO: 323713 - DNA, 526 bp, Homo sapiens
  misc_feature: GZ8MTXP02FZ44X.4.39.D06.1.454.CMB.2.raw
  modified_base (306)..(306): a, c, t, g, unknown or other
  misc_feature (306)..(306): n is a, c, g, or t
  modified_base (345)..(345): a, c, t, g, unknown or other
  misc_feature (345)..(345): n is a, c, g, or t
  modified_base (422)..(422): a, c, t, g, unknown or other
  misc_feature (422)..(422): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggaaagtcagtcaccatctcctgcactggaaccagcagtgacgttggtcgttataactatgtctcctggtaccaacaacacccaggcaaacgcccccaaattcataatttangagtcactaagcggccctgaggggtccctgatcgcttcnctgcctcaagctggcacacgcctcctgaccgtcactgggctccgaggctgaggatgagctgtattatattgcagctnatatgcaggcagttacaatgtagatagttcggacggaacggtaaccaaacgtcgtaacccgtcgtaaggtcacgacccgaaggtcctccgcccccgtggtaccc

SEQ ID NO: 323714 - DNA, 529 bp, Homo sapiens
  misc_feature: GZ8MTXP02GMZGB.4.39.D06.1.454.CMB.2.raw
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttataactatgtctcctggtaccaaacaacacccaggacaaagccccaaaatcaataatttatgaggtcaactaagcgccctcaggggtccctgatcgcttcctctcgcctccgaaaggctggcaaacgacggcctccctgaccgtctctgggctcccgaggctgagatgagctgattattatgcagctanatangnagctatanatgagtatagtcggacggaacggaacctaaacgtacgaccgtaccgtaagtacacgacccgaagtccgtccgaccccgtcg

SEQ ID NO: 323715 - DNA, 521 bp, Homo sapiens
  misc_feature: GZ8MTXP02IYP5S.4.39.D06.1.454.CMB.2.raw
  modified_base (372)..(372): a, c, t, g, unknown or other
  misc_feature (372)..(372): n is a, c, g, or t
  modified_base (398)..(398): a, c, t, g, unknown or other
  misc_feature (398)..(398): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacaacacccagcaaagcccccaaattcataatttatgagtcactaagcgccctcgaggggtccctgatcgcttcctctgcctcaagctggcaacacggcctcccngaccgtctctgggctccaggctgagntggagctgattattattgcagctcatatgcaggctagttacaatgtagtattagttcgggacgggtaaggaaccaacgtcgacccgtcgtaacggtcacgacccaaggtctccgccccgtcgg

SEQ ID NO: 323716 - DNA, 589 bp, Homo sapiens
  misc_feature: GZ8MTXP02JTW2I.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctgtaccaacaacacccaggcaaacgccccaaattcataattatgagtcactaagcgccctcgaggggtccctgatcgtcttccctctcgtcctaccaaggctggccaaccacggccctccctgaccccgtctcgtcgggcctccgaggctggagatggaggtctagatttagttattgcagtctacatatcgacaggtctaagttacaagttgtacgtaagttacggttacgggacgggtaaacgggaacctaaaaccgtcggtaacccgttaccgtaacgggtaccaacggtacccccgaaaggtccctaccggtcccccgttaccggg

SEQ ID NO: 323717 - DNA, 590 bp, Homo sapiens
  misc_feature: GZ8MTXP02JKIOF.4.39.D06.1.454.CMB.2.raw
  modified_base (304)..(304): a, c, t, g, unknown or other
  misc_feature (304)..(304): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggacaaacgccccaaatcataattangagtcactaagccggccctcgacgggtcctgatcgtcttccctctcgccctaccaaggtcctacgggccaaaccgaccgggtccccttacccgtcgtaccccgttcctcgtcggggcctcccgaggctggacggatggagctagtattattatgacagtctacatatgcaggctaagttacaagtgtagtatacggttcgggacgggtaaacgggaaccctaaacgtcggtaacccgtaccgtaaggtccgaacggacccgaaggtccctccggcccccgttacgg

SEQ ID NO: 323718 - DNA, 535 bp, Homo sapiens
  misc_feature: GZ8MTXP02H7HK5.4.39.D06.1.454.CMB.2.raw
  modified_base (379)..(379): a, c, t, g, unknown or other
  misc_feature (379)..(379): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
tcagagcactgtagcacgaccggtgctcgatttagtgacatctcgcagttctttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgcccccaaattcataatttatgaggtcactaagcggccctcgaggggtccctgatcgcttctctcgcctccaaggctgggcaacgaccggcctccccgtgaccgtcctcgtcggggcctccaggcttgnggatggaggctgtattagttattgcagctacatatgcaggcagttacaatgtgattagttggacggagggaccaaacgtgaccgtcgagtcagcccgtaaggctcgccccctggtccactctcgttcccaccctctcctacncgtcnctctcgcgg

SEQ ID NO: 323719 - DNA, 527 bp, Homo sapiens
  misc_feature: GZ8MTXP02ID0JA.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtcccctgatcgcttcctctgcctccaaggctggcaacacggccctccctgaccgtctctggggctcccgaggctgagatgaggctgattattattgcagctcatatgcaggcagttacaatgtgaatagttcgggcggaagggaccaaacgtggacccgtccgtaaggtccagacccaaaggctaccgcccgttcg

SEQ ID NO: 323720 - DNA, 533 bp, Homo sapiens
  misc_feature: GZ8MTXP02IOXJT.4.39.D06.1.454.CMB.2.raw
  modified_base (227)..(227): a, c, t, g, unknown or other
  misc_feature (227)..(227): n is a, c, g, or t
  modified_base (299)..(299): a, c, t, g, unknown or other
  misc_feature (299)..(299): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccttccgcgtccgggtctcctggacagtcagtcaccatctcctgcactggaaccngcagtgacgttggtcgttataactatgtctctggtaccaacaacacccagcaaagccccaaatcataattangagtcactaagcgccctcaggggtccctgatcgcttcctctcgcctccaaggctggcaacaccggccctccctcgaccgtctcgtcgggcctccgagctgacgatggaggctgattattattgcagctcatactgcaggctagttacaatgtagtattagttcggacggtaagggaccaaaacgtcgaaccgtaccgtaaggtcaacgcccgaaggcctacgtcccccgtacgg

SEQ ID NO: 323721 - DNA, 542 bp, Homo sapiens
  misc_feature: GZ8MTXP02GT6Z1.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacaacaccagcaaacgccccaaatcataattatgagtcactaagcgccctcgacgggtccctgatcgtcttccctctcgcctccaaggcctggccaaacacggccctccctcgaccgtctcgtcgggctccgaggctgagatgagctgtattattattgactagctcatatgacaggctaaggttacaagttgtagtaagttagttcgggacggtaagggaaccaaacgtcgaccgtcgtaaggtcacgacccgaaggcctccgaccccgtacgg

SEQ ID NO: 323722 - DNA, 590 bp, Homo sapiens
  misc_feature: GZ8MTXP02F3ZXF.4.39.D06.1.454.CMB.2.raw
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
tcagagcactgtagcacgaccggtgctcgatttagtgacatctcgcagttctttgggttttgggggaagtgtggtacggcctgggggtccctgagactctcctgtacagcctctggattctcctttgatgattatggcatgagctgggtccgccaagctccagggaaggggctggagtgggtgtctggtatgaattggagtggcggtagtacagcttatgcagactctgtgaagggccattcaccatctccagagacaacgccaagactccctgtatctgcaattgaacagtctgagagccgaggacacggccttgtattactgtgcgaagaactagtttaggggngtgtagtggtaaacngctgcttagttcgtcgtacgttgggtttgacgtacgtcggcccgagggacgtcccgtcggtccaccgtctcctcacgccctacccaccgacggccctacgttccggttcccttcccccgtcggcccgtcccgtcgccctaccgacggacgacccgacccgtccgacgacgaccaccgacggcccggcccgtcgggcctcggcccgtcggtaccgaacggtaccttaccg

SEQ ID NO: 323723 - DNA, 526 bp, Homo sapiens
  misc_feature: GZ8MTXP02GYPD9.4.39.D06.1.454.CMB.2.raw
  modified_base (302)..(302): a, c, t, g, unknown or other
  misc_feature (302)..(302): n is a, c, g, or t
  modified_base (425)..(425): a, c, t, g, unknown or other
  misc_feature (425)..(425): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacaacacccagcaaacgccccaaatcataatttangagtcactaagcggccctcgaggggtccctgatcgcttcctctcgcctcaaggctggcaacacggcctccctgacctctcgtcggctccgagctgagatgagctgattattattgacagtctnatatgacaggcaagttacaagttgtagtattacgttcgggacggtaagggaccaaacgtcgaccgtacgtaaggtcacgtaccaaggctaccgcccctcgg

SEQ ID NO: 323724 - DNA, 599 bp, Homo sapiens
  misc_feature: GZ8MTXP02GCP2E.4.39.D06.1.454.CMB.2.raw
  modified_base (283)..(283): a, c, t, g, unknown or other
  misc_feature (283)..(283): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacaacaccagacaaacnccccaaatcataattatgagtcactaagcggccctcgacggggtccctgatcgtcttcctctcgcctaccaaggcctggccaaccacggccctaccctgacccgtctcgtcgggctccgaggctgagatgagctgattattattgactagtctactaatatcgacgaggtactaaagtttacaaattggtagtaaagttacgttaccggggacgggtaaacggggaaaccctaaaaccgttacggaaccccggttaccgtaaaggggttaccaacggaccccgaaagggcccttacccggccccccgtttaccggg

SEQ ID NO: 323725 - DNA, 541 bp, Homo sapiens
  misc_feature: GZ8MTXP02I7NVO.4.39.D06.1.454.CMB.2.raw
  modified_base (197)..(197): a, c, t, g, unknown or other
  misc_feature (197)..(197): n is a, c, g, or t
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
  modified_base (436)..(436): a, c, t, g, unknown or other
  misc_feature (436)..(436): n is a, c, g, or t
  modified_base (501)..(501): a, c, t, g, unknown or other
  misc_feature (501)..(501): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccgggtctcccgganagtcagtcaccatctcctcgcactggaaccacgcagtgacgttggttgttataactatgtctctgtacaacaacaccaggacaaacgaccccaaactacataattattnaggtacactaagcggccctcaggggtccctnatcgcttctctgcctccaagctcgnacacgcctcctcgacgtctntgggctccagctgaggatgaggctgattattattgcagcttcatattggcaggnagttaacaatgtgattaagttcgggacggagggaaccaaaactcggaacccgtcgtacgggtaanaaccggcccgaaaggtccttacggcccccctttcgggtac

SEQ ID NO: 323726 - DNA, 521 bp, Homo sapiens
  misc_feature: GZ8MTXP02J28HQ.4.39.D06.1.454.CMB.2.raw
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (414)..(418): a, c, t, g, unknown or other
  misc_feature (414)..(418): n is a, c, g, or t
  modified_base (422)..(423): a, c, t, g, unknown or other
  misc_feature (422)..(423): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttaataactatgtctcctggtaccaaacaacacccaggcaaagcccccaaattcataaatttangagtcactaagcggccctnaggggtccctgatcgcttctctgcctcaagctggcaacacgcncctnaccgtctcnggctccaggctgagagngagntntatatatnnnnnatanngagacgagtatatagtagtagtagtacggacggacggaacgaacgtacgtaccgtaccgtaacgtacgacgaccgaacgaccgtaccgtacccgtccg

SEQ ID NO: 323727 - DNA, 550 bp, Homo sapiens
  misc_feature: GZ8MTXP02JEDIC.4.39.D06.1.454.CMB.2.raw
  modified_base (305)..(305): a, c, t, g, unknown or other
  misc_feature (305)..(305): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctgtaccaacaacacccaggacaaacgccccaaattcataattangagtcactaagcgccctcgacgggtccctgatcgcttcctctcgcctacaggctggcaaccgacggccctcccgtagaccgtctcgtcgggcctccgagcgtggagactggagtctgatttattagttgcgaacgtctacatatgacgaggctaagttacaatgtgtaatgtacgggacggaagggaacctaaacgtccgaaccgtacgtaagcgacgacccgaacgcctcccggccccttccgg

SEQ ID NO: 323728 - DNA, 631 bp, Homo sapiens
  misc_feature: GZ8MTXP02HCN9Q.4.39.D06.1.454.CMB.2.raw
  modified_base (253)..(253): a, c, t, g, unknown or other
  misc_feature (253)..(253): n is a, c, g, or t
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
tcagagcactgtagcacgaccggtgctcgatttagtgacatctcgcagttctttgggttttgggggaagtgtggtacggcctggggggtccctgagactctcctgtacagcctctggattctcctttgatgattatggcatgagctgggtccgccaagctccagggaaggggctggagtgggtgtctggtatgaattggagtggcggtagtacagcttatgcagactctgtgaaggccattcacatctcaganacacgcaagactcctgtatctgcaattgaacagtctgagagccgaggacacggcctttgtattactgtgcgaagaactagtttaggggngtagtaggtggtaaacgngtctgtacttagttccgtacgtacgtttggggtttacgacgttacggtcggggaccgaggggacgtcccgtggtccctaccgtcctcctacgaccgtccctacccgaaccggaccggccctacgtcccggttccccttcccccgtcggccccgtcccgtcgtcccgtaccgacggaccgacccgtacccgaccggacgacgaccgaccgtaccggcccggtcccggtcggtccgtccggtccgtacggtaccgtaaccggtacccttaccg

SEQ ID NO: 323729 - DNA, 558 bp, Homo sapiens
  misc_feature: GZ8MTXP02G0GD1.4.39.D06.1.454.CMB.2.raw
  modified_base (305)..(305): a, c, t, g, unknown or other
  misc_feature (305)..(305): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggacaaagccccaaattcataatttangagtcactaagcggccctcgaggggtccctgactcgtcttcctctcgcctccaaggctggcaacacggccctccctgacccgtctccgtgggcctccgaggctgaggtatggaggctagatttattattgcagctcatatgcaggctaggttaacaagttgtagtagtacgttcggacgggtaagggtaacccaaaacgtcggacccgtacgtaagggtccaacgacccgaaggcctaccggcccccgttcgg

SEQ ID NO: 323730 - DNA, 607 bp, Homo sapiens
  misc_feature: GZ8MTXP02JRWNN.4.39.D06.1.454.CMB.2.raw
  modified_base (300)..(300): a, c, t, g, unknown or other
  misc_feature (300)..(300): n is a, c, g, or t
  modified_base (377)..(377): a, c, t, g, unknown or other
  misc_feature (377)..(377): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacaacaccagacaaacgccccaaatcataattangagtcactaagccgccctcgacgggtccctgactcgtcttcctctcgcctcgaggctggccaacgcggccctcccgngtacccgtctcgtcgggcctccgaggctggaggtatggagtctagtatttagttagtgactacgtcttacgtaatagtgaccgtaaggtccgtaaagtttaacgaagttcggttagtaacgttacggttaccggggacgggtaaacggtaaacccgtaaacgtccggtaacccgttaccgtaacggtaccacggtaccccgaacggtcccgtacccggtcccccgttcgg

SEQ ID NO: 323731 - DNA, 510 bp, Homo sapiens
  misc_feature: GZ8MTXP02F7U67.4.39.D06.1.454.CMB.2.raw
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagcaaacgccccaaatcataatttatgagtcactaagcgccctcaggggtccctgatcgcttcctctgcctccaggctggcaacacggcctccctgaccgtctctgggctcccgaggctgagatgagctgattattattgcagctcatatgcaggctagtacaatgtagatatcggacggagggaaccaaacgtgaccgtacgtaaggtcacgcccaaggctacgccccctcgg

SEQ ID NO: 323732 - DNA, 577 bp, Homo sapiens
  misc_feature: GZ8MTXP02JSWSL.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagccccaaattcataatttatgaggtcactaagcggccctcaggggtccctgatcgtcttcctctcgcctcaaggctggcaaccacggccctccctgacccgtctcgtcgggcctcccgaggcctggagatcggagctagattattatgcagtctcatatgacaggtctaggtttacaaagttgtagtaacgttagtttacggggacgggaaaggggtaacccaaaacgttcggaaccccggttcgtaaagggttcaacgggcccaaagggccttaccggaccccccttccggg

SEQ ID NO: 323733 - DNA, 517 bp, Homo sapiens
  misc_feature: GZ8MTXP02FIP5R.4.39.D06.1.454.CMB.2.raw
  modified_base (306)..(306): a, c, t, g, unknown or other
  misc_feature (306)..(306): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagcaaacgccccaaatcataattatgagtnactaagcgccctcaggggtccctgatcgcttcctctgcctccaaggctggcaacacggcctccctgaccgtctcgtcgggctcccgaggctggaggatggaggctgatttattattgcagctcatatgcaggcaagttacaatgtagatagttcggacggagggaaccaaacgtcgaccgtactaaggtcacgaccaaggctcgcccctcg

SEQ ID NO: 323734 - DNA, 523 bp, Homo sapiens
  misc_feature: GZ8MTXP02HU1G1.4.39.D06.1.454.CMB.2.raw
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctctggtaccaacaacacccaggcaaacgccccaaattcataattatgagtcactaagcggcctcaggggtccctgatcgcttcctctcgcctcaaggctggcaacacggcctccctgaccgtctctcggctccgagctggagatgagctgattatattgcagctnatangcaggctagttanatgtagatagttcggacggaggaacccaaaacgtcgacccgtacgtaaggtcaacggaccccaagggcctccggccccctacgg

SEQ ID NO: 323735 - DNA, 624 bp, Homo sapiens
  misc_feature: GZ8MTXP02IBCIQ.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctcgcgtccgggtctcctggacagtcagtcaccatctcctgcactggaaccagcagtgacgttggtcgttataactatgtctctggtaccaacaacaccagcaaacgccccaaattcataatttatgaggtacataagcggccctcgacgggtccctgatcgcttcctctcgcctcagctggcaacgacgcctccctgaccgtctcgtcgggctccgaggctggaggatggaggtctagtatttattagttgacagtcttcattagtcgacgtaggactaaggtttaacaagtttggtagtaagttacggtttaccggggaacgggtaaacggggtaaacccgtaaaaccgttccggtaaccccggttacccggtaacggggttacccaaacccgggtaccccgaaaaccggggtccctttaccccggtacccccccgtttacccggg

SEQ ID NO: 323736 - DNA, 559 bp, Homo sapiens
  misc_feature: GZ8MTXP02JUN2S.4.39.D06.1.454.CMB.2.raw
  modified_base (305)..(305): a, c, t, g, unknown or other
  misc_feature (305)..(305): n is a, c, g, or t
  modified_base (442)..(442): a, c, t, g, unknown or other
  misc_feature (442)..(442): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaaacaacacccaggcaaacgccccaaattcataattangagtcactaagcggccctcgaggggtccctgatcgcttcctctcgcctccgaaggctgggccaaaccgacggccctccctgacccgtctcgtcgggcctccgaggctggaggatggagtctgattattatgcagctnatatgacaggctagttaacaatgtagaattagttcgggacggaagggaaccaaaacgtcggaacccgttacgtaaggtccaacggacccgaaaggcccgttccgacccccgtttcgg

SEQ ID NO: 323737 - DNA, 576 bp, Homo sapiens
  misc_feature: GZ8MTXP02GIQEI.4.39.D06.1.454.CMB.2.raw
  modified_base (300)..(300): a, c, t, g, unknown or other
  misc_feature (300)..(300): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctctgtaccaacaacacccagacaaacgccccaaatcatattangagtcataagcgccctcgaggggtccctgactcgcttcctctcgcctccgaaggctggccaacgaccggccctcccgtcgaccgtctcgtcgggcctccgaggctgagatgaggctgatttagttattgacacgtctactattagtcgacgacgggtactaagttaacaagttgtagtagttacggttcgggacgggaacgggtaacctaaaacgtcggaacccgttacgtaacggtccaacggtacccgaacggtcctccggcccccgtttacgg

SEQ ID NO: 323738 - DNA, 593 bp, Homo sapiens
  misc_feature: GZ8MTXP02F7X8I.4.39.D06.1.454.CMB.2.raw
  modified_base (296)..(296): a, c, t, g, unknown or other
  misc_feature (296)..(296): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgtaccaacaacaccagacaacgccccaatcatattangagtcataagcgccctcgacgggtccctgatcgtcttcctctcgcctcgaacggctcggccaaacgaccggtccctcccgtcgacccgtctcgtcgggcctccgaggctaggaggtacgtggaggtcttagtatttattaagttcgactagtctactatagtcgacgaggtactaagttacaagttgtagtagttacggttcgggacgggtaacgggaaacctaaacgtaccggtaacccgttacgtaacggtaccgaacggacccgaaggtcccgtacccggtacccccgttccgg

SEQ ID NO: 323739 - DNA, 516 bp, Homo sapiens
  misc_feature: GZ8MTXP02GA0MA.4.39.D06.1.454.CMB.2.raw
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagcaaagcccccaaatcataatttatgagtcactaagcgccctcaggggtccctgatcgcttcctctcgcctcaaggctggcaacacggcctccctgaccgtctctgggctcccgagctgagatgagctgattattattgcagctnatangnagctagtanatgtagtatagtcggacggacggaacctaacgtcgtaccgtacgtaacgtcacgaccgacggtcctccgtccccgtcg

SEQ ID NO: 323740 - DNA, 545 bp, Homo sapiens
  misc_feature: GZ8MTXP02GBLWQ.4.39.D06.1.454.CMB.2.raw
  modified_base (296)..(296): a, c, t, g, unknown or other
  misc_feature (296)..(296): n is a, c, g, or t
  modified_base (426)..(426): a, c, t, g, unknown or other
  misc_feature (426)..(426): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgtaccaacaacaccagcaaagccccaaatcatattangagtcactaagcgccctcgacgggtccctgactcgtcttcctctcgcctcaaggctggcaacacggcctccctgacctctctgggcctccgaggctgagatgagctgtattattatgctagctacattangtacaggctaagttacaagttgtagtattagttcggacggtaaacggaacctaaaacgtcgtaacccgtacgtaacggtccaacggacccgtaaagggtcctaccggtcccccttacgg

SEQ ID NO: 323741 - DNA, 622 bp, Homo sapiens
  misc_feature: GZ8MTXP02G9Z1G.4.39.D06.1.454.CMB.2.raw
  modified_base (264)..(264): a, c, t, g, unknown or other
  misc_feature (264)..(264): n is a, c, g, or t
tcagagcactgtagcacgaccggtgctcgatttagtgacatctcgcagttctttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacaacaccagcaaagccccaaattcataattangagtcactaagcgcctcagggtccctgatcgcttctctgcctccaaggctggcaacacggcctccctgaccgtcctcgtgggcctccgaggctggacggatggaggctgatttattatgcagtctcatagtgacaggactaagttacaagtgtagtaattagttcgggacggaacgggaacccaaaacgtcggaacccgtcgtaacgggtaccaacggaccccgaaacgggtcctacccggtacccccttcgggtacctaacccgttcccgttacccgtttaccccccgtaacccccttccccgttaccccttaaacccgtacggttcctacccgtttaccggttacggtacccgggg

SEQ ID NO: 323742 - DNA, 548 bp, Homo sapiens
  misc_feature: GZ8MTXP02HS55U.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctggtaccaacaacacccaggcaaacgccccaaattcataattatgagtcactaagcggccctcgaggggtccctgatcgcttcctctcgcctccaaggctggcaacacggcctcccctgaccgtctctcgggctcccgaggcctggaggatggaggctgattattattgcagtctactatatgacgaggcagtttaacaagtgtagattagttcggacggtaacggggaccaaacgtcgaacccgtcgtaaggtcgaacgcccgaaaggtcctcgcccccgttccgg

SEQ ID NO: 323743 - DNA, 573 bp, Homo sapiens
  misc_feature: GZ8MTXP02JVL3V.4.39.D06.1.454.CMB.2.raw
  modified_base (272)..(272): a, c, t, g, unknown or other
  misc_feature (272)..(272): n is a, c, g, or t
  modified_base (338)..(338): a, c, t, g, unknown or other
  misc_feature (338)..(338): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgtaaccaaaacnccaggacaaacgccccaaattcataattatgagtcataagcgcctgacgggtcctgactcgcttcncctcgcctcaagctggacacaccggcctccgtgaccgtctcgtcgggcctccgaggtctaggaggtactggacggtcttagtatttattattcggctaggcttacattacgtgacaagggtctaagtacaattggtagtaattacggtcgggacgggtacgggaaacctaaacgtcgtaacccgtcgtagggtaaccacggtacccgaacggtccctcccgtccccgtcgtaccc

SEQ ID NO: 323744 - DNA, 519 bp, Homo sapiens
  misc_feature: GZ8MTXP02JXH8O.4.39.D06.1.454.CMB.2.raw
  modified_base (455)..(455): a, c, t, g, unknown or other
  misc_feature (455)..(455): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgcccccaaattcataatttatgagtcactaagcggccctcaggggtccctgatcgcttcctctgcctccaaggctggcaacacggccctccctgaccgtctcgtcgggcctccgaggctgaggatgaggctgattattattgcagctcatatgcaggcagttacaatgtnatatcggcggaggaccaaagtcgaaccgtcgtaaggtcacgcccaaggcctaccgcccctacgg

SEQ ID NO: 323745 - DNA, 526 bp, Homo sapiens
  misc_feature: GZ8MTXP02FMI3R.4.39.D06.1.454.CMB.2.raw
  modified_base (445)..(445): a, c, t, g, unknown or other
  misc_feature (445)..(445): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgtttggtcttataactatgtctctggtaccaacacacccagcaaagccccaaatcataattatgagtcactaagcggccctcaggggtccctgatcgcttctctgcctcaaggctggcaacacggcctccctgaccgtctcgtgggctcccgaggctggaggatgaggctgattattattgcagctcatatgcaggcagttacaatgtnatagttcgggcggtaagggacctaaaacgtcggaacccgttccgtaagggtcaacgcccgaaggtctccgcccccgttccg

SEQ ID NO: 323746 - DNA, 519 bp, Homo sapiens
  misc_feature: GZ8MTXP02HVJFO.4.39.D06.1.454.CMB.2.raw
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (301)..(301): a, c, t, g, unknown or other
  misc_feature (301)..(301): n is a, c, g, or t
  modified_base (420)..(420): a, c, t, g, unknown or other
  misc_feature (420)..(420): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatcctccngcactggaaccngcagtgacgttggtcgttataactatgtctctgtaccaacaacaccagacaaacgccccaaatcataattangagtcactaagcgcctcgagggtccctgactcgcttcctctcgcctccaagcctgcaacacggccctccctcgaccgtctctcggctccgagctgagatcgagtctgtattattattgnagtctacatagtgcaggacagttacaatgtgactagttcggacgtagggaaccaacgtcgaccgtactaaggtcacgtaccgaagccgtcgccccgtcg

SEQ ID NO: 323747 - DNA, 610 bp, Homo sapiens
  misc_feature: GZ8MTXP02GGP9R.4.39.D06.1.454.CMB.2.raw
  modified_base (305)..(305): a, c, t, g, unknown or other
  misc_feature (305)..(305): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctgtaccaacaacacccaggacaaacgccccaaattcattaattangagtcactaagccgccctcgacggggtccctgatcgtcttccctctcgccctaccgaacggctcgggccaaaccgaccggtcccctcccgtcgtaccgttcctccgtcgggcctacccgaggtcctaggagatcggagtccttagaattttagttaattcggacctagtcctactattatggaccaggacttaagttaacaagttgtagtaacttaggttaccggacgggtaacggaacctaaaacgtcgtaacccgttcgtaacggtcaacggaccccgaaggtcctacccggcccccgttcgg

SEQ ID NO: 323748 - DNA, 529 bp, Homo sapiens
  misc_feature: GZ8MTXP02IRHVM.4.39.D06.1.454.CMB.2.raw
  modified_base (229)..(229): a, c, t, g, unknown or other
  misc_feature (229)..(229): n is a, c, g, or t
  modified_base (296)..(296): a, c, t, g, unknown or other
  misc_feature (296)..(296): n is a, c, g, or t
  modified_base (403)..(403): a, c, t, g, unknown or other
  misc_feature (403)..(403): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtcccgggtctcctggacagtcagtcacatctcctgcactggaaccngcagtgacgttgtcttataactatgtctctgtaccaacacaccagcaagccccaaatcataatttangagtcactaagcgccctcgagggtccctgatcgcttcctctgcctccaagctgccaacacggcctccctgaccgtctctcgggctccagctgagatggagctgattnttattgcagctacatatgcgagctaagttacaagttgactagttacgttcgggcggtaaacggaccaaaacgtcgacccgtacgtaaggtccgaacgtcccaaacggtcctaccgtcccccgtcgg

SEQ ID NO: 323749 - DNA, 533 bp, Homo sapiens
  misc_feature: GZ8MTXP02JMQ01.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacaacacccaggcaaacgccccaaattcataatttatgagtcactaagcgccctcgaggggtccctgatcgcttccctctgcctcaaggctggcaacacggcctccctgacccgtctctgggcctccgagctgaggatggagctgatttatattgcagctcatatgacaggctagttacaatgtagtattagtcgggacggacggaaccaacgtcgacccgttcgaaggtccacggaccccaaggtcctaccggcccccgttacgg

SEQ ID NO: 323750 - DNA, 540 bp, Homo sapiens
  misc_feature: GZ8MTXP02GA8J2.4.39.D06.1.454.CMB.2.raw
  modified_base (280)..(280): a, c, t, g, unknown or other
  misc_feature (280)..(280): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacacaccagcaacnccccaaatcatattatgagtcactaagcgccctcagggtccctgatcgcttcctctcgcctcaaggctggcaacaccggcctccctcgacccgtctcgtcgggcctccgaggctggagactgagctgattattattgactagctacatatgcgaggtctaagttaacaagttgtagtaattacgttcgggacggaagggtaaccctaaacgtcgaccgtacgtaacggtcaacgacccgaacgccgtccgccccgtaccg

SEQ ID NO: 323751 - DNA, 531 bp, Homo sapiens
  misc_feature: GZ8MTXP02HJB6R.4.39.D06.1.454.CMB.2.raw
  modified_base (227)..(227): a, c, t, g, unknown or other
  misc_feature (227)..(227): n is a, c, g, or t
  modified_base (298)..(298): a, c, t, g, unknown or other
  misc_feature (298)..(298): n is a, c, g, or t
  modified_base (327)..(327): a, c, t, g, unknown or other
  misc_feature (327)..(327): n is a, c, g, or t
  modified_base (343)..(343): a, c, t, g, unknown or other
  misc_feature (343)..(343): n is a, c, g, or t
  modified_base (432)..(432): a, c, t, g, unknown or other
  misc_feature (432)..(432): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtcgttataactatgtctctgtaccaacacaccagacaacgccccaattcaataattangagtcactaagccgccctgacgggtcccngtattgtcttcctctncctcaggctgcaacacggcctcctgaccgtctcgtgggcctccgaggctgacgtatgagtctgtattattattgactagtctacattancgacgaggctaagttacaagtgtagtatacgttcggacggacggaaccaacgtcgtacccgtacgtaagtcacgacccgaaggcctccggacccctcgg

SEQ ID NO: 323752 - DNA, 628 bp, Homo sapiens
  misc_feature: GZ8MTXP02J0C3P.4.39.D06.1.454.CMB.2.raw
  modified_base (305)..(305): a, c, t, g, unknown or other
  misc_feature (305)..(305): n is a, c, g, or t
  modified_base (467)..(467): a, c, t, g, unknown or other
  misc_feature (467)..(467): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgacgttggtcgttataactatgtctcctggtaccaacaacacccagacaaacgccccaaattcaataattangagtcactaagcgccctcgagggtccctgatcgtcttccctctgccctaccgaaggcctgggccaaacgaccggtccctccgtacgacccgttctcgtcgggcctcccgaggtcctggaagagtggaacggtcttagtaatttattagttcgctagtcctanatatcgacgtaacgggctaagttaacaagttgtagtaacgttaggttacggggacgggtaaacgggaaccctaaaacgttccgggaaacccgtttccggtaacggttaccgaaccgggtacccccgtaaaaggcccttcccggtacccccccgtttccggg

SEQ ID NO: 323753 - DNA, 579 bp, Homo sapiens
  misc_feature: GZ8MTXP02JQNOC.4.39.D06.1.454.CMB.2.raw
  modified_base (448)..(448): a, c, t, g, unknown or other
  misc_feature (448)..(448): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacaccagcaaacgccccaaatcataattatgagtcataagcgccctagacgggtccctgactcgcttcctctgcctacaaggctggccaaccgaccggccctaccctgaccgtctcgtcgggcctccgagctaggagactggaggctgagtttattagttgacgtagtctacattancgacgaggactaagttaacgtaatgtagtagtttacgttcgggacgggtaaacggaaccgtaaaacgtcggaacccgttacgtaacggtaaccgacgtacccgaacggtccttcccggacccccgttacgg

SEQ ID NO: 323754 - DNA, 570 bp, Homo sapiens
  misc_feature: GZ8MTXP02JW30K.4.39.D06.1.454.CMB.2.raw
  modified_base (443)..(443): a, c, t, g, unknown or other
  misc_feature (443)..(443): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgccccaaattcataatttatgagtcactaagcggccctcaggggtccctgatcgcttcctctgcctcaaggctggccaacacggccctccctgacccgtctctgggccttcccgaggctggacggatggaggctgatttattattgcagctacattangcaggccaggttacaagtgtagtacttagttcgggacgggtaacgggaaccaaaacgttcggaaaccccgttcgtaagggtccaacggtccccgaaaggggtccttaccggccccccgtttaccggg

SEQ ID NO: 323755 - DNA, 618 bp, Homo sapiens
  misc_feature: GZ8MTXP02F3ULC.4.39.D06.1.454.CMB.2.raw
  modified_base (302)..(302): a, c, t, g, unknown or other
  misc_feature (302)..(302): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgacgttggtcttataactatgtctcctgtaccaacaacaccagacaaacgaccccaaatcatattangagtcataagccgccctcgacgggtccctgactcgcttcctcctcgcctaccgaaggctacggccaaaccgaccggaccctccccgtcgacccgtctcgtcgggcctccgaggctaggaggtatggaggctagtaatttatttagttgactacgtctactaagttagtcgacgaagggtacttaacggtttaacaaagtttggtagtaagtttacggtttacggggacgggaaacggggtaaacctaaacggtacgtacccggttaccgtaagggtccaacggacccgaacgggtcctccggtcccccgtttacgg

SEQ ID NO: 323756 - DNA, 568 bp, Homo sapiens
  misc_feature: GZ8MTXP02HFFYK.4.39.D06.1.454.CMB.2.raw
  modified_base (299)..(299): a, c, t, g, unknown or other
  misc_feature (299)..(299): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgtaccaacacaccagacaaacgccccaaatcataatttangagtcactaagcggaccctcgacgggtccctgactcgtcttcctctcgcctaccaaggcctagggccaaacgaccggccctccctcgacccgtctcgtcgggcctccgaggctaggacggatggaggctagatttattattgcacgtctacatagtgacaggtctaagttacaagttgagtatacgttcgggacggaacgggaaacctaacgtccgacccgttacgtaacggtacacgacccgaaggtcctacccggtacccccttcgg

SEQ ID NO: 323757 - DNA, 567 bp, Homo sapiens
  misc_feature: GZ8MTXP02IZQCY.4.39.D06.1.454.CMB.2.raw
  modified_base (228)..(228): a, c, t, g, unknown or other
  misc_feature (228)..(228): n is a, c, g, or t
  modified_base (296)..(296): a, c, t, g, unknown or other
  misc_feature (296)..(296): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttataactatgtctctgtaccaacaacaccagcaacgccccaaatcatattangagtcactaagagccctcgagggtccctgatcgcttcctctcgcctcaaggctggccaacaccggcctccctgacccgtctcgtcgggcctccgagcgtagagatggagtctagtatttattattgactacgtctactatatgaccgtaggactaaggttacaagttgtagtaacgtacgttcgggacggtaaacgggaacctaaaacgtcgtacccgttaccgtaaggtccgaacgtaccccgtaaggccctaccggtccccgttacccg

SEQ ID NO: 323758 - DNA, 540 bp, Homo sapiens
  misc_feature: GZ8MTXP02HA248.4.39.D06.1.454.CMB.2.raw
  modified_base (405)..(405): a, c, t, g, unknown or other
  misc_feature (405)..(405): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagccccaaattcataatttatgagtcactaagcgccctcgacgggtccctgactcgcttcctctgcctcaaggctggcaacgacggcctcctcgaccgtctcgtgggctcccgaggctgagntgaggctagattattagttgctagctacatatcgacaggactaggttacaagtgtagtatagttcgggacggtaacggaaccaacgtcgaccgtacgtggtacacggacccaacggccgtccgacccccgttcgg

SEQ ID NO: 323759 - DNA, 663 bp, Homo sapiens
  misc_feature: GZ8MTXP02G3FRK.4.39.D06.1.454.CMB.2.raw
  modified_base (298)..(298): a, c, t, g, unknown or other
  misc_feature (298)..(298): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttaatactatgtctctgtaccaacacacccagcaaagccccaaatcataatttangagtcactaagccggccctcgaggggtccctgactcgcttccgtctcgtcctaccaaggccttagggccaaacgaccggtccctacccgtgtacccgttctcgttcggggccttcccgaggccgttaggacggtaactcgggaaggtccgtaggtaactttaagtttaagtttcgaccgtaaggtccctttaacgtaagttacgtacggaccgtacgggtacgttaaacggtttaactaagttacggtacgtaacgttacggttacggggaccgggtaaacggtaaaccgtaaccgtaccggtacccgttacgtaacggtaccgtaaccggacccgtaacggtccgtacccggtaccccgttacg

SEQ ID NO: 323760 - DNA, 595 bp, Homo sapiens
  misc_feature: GZ8MTXP02GU33A.4.39.D06.1.454.CMB.2.raw
tcagagcactgtagcacgaccggtgctcgatttagtgacatctcgcagttctttgggggggtctcagaaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtacgttataactatgtctcctgtaccaacaacacccagacaaacgccccaaatcataattatgagtcataagcgccctcgagggtccctgactcgtcttcctctcgcctaccaaggcctcgggccaaaccgaccggccctccccgtacgtacccgtctccgtcgggcctcccgaggtcctaggaggagtggacggtacttagtatttaatttagttggtaccagtctacaatactgcaaggtctaaaggttacaaagtgtagtatacgttacggacgggtaacgggaacctaaaacgtcgtaacccgtaccgtaagtacgaacgcccgaaggtccctacggtacccccgttcgg

SEQ ID NO: 323761 - DNA, 543 bp, Homo sapiens
  misc_feature: GZ8MTXP02I2Y99.4.39.D06.1.454.CMB.2.raw
  modified_base (228)..(228): a, c, t, g, unknown or other
  misc_feature (228)..(228): n is a, c, g, or t
  modified_base (297)..(297): a, c, t, g, unknown or other
  misc_feature (297)..(297): n is a, c, g, or t
  modified_base (325)..(325): a, c, t, g, unknown or other
  misc_feature (325)..(325): n is a, c, g, or t
  modified_base (370)..(370): a, c, t, g, unknown or other
  misc_feature (370)..(370): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttgtcgttataactatgtctctgtacaacaacaccagcaaacgccccaaatcataattangagtcactaagcgccctgacgggtcccngatcgcttcctctcgcctccaaggctggcaacaccggcctcccgngacccgtctcgtcgggctcccgaggtctggagatcggaggctgatttattattcgacagtctacatagtgccgaggactagttacaagtgtagtaattagttcgggcggaaacggaccaaaacgtcgaacccgtctaaggcgaacgtacccgaaggtcctccgccccctacgg

SEQ ID NO: 323762 - DNA, 548 bp, Homo sapiens
  misc_feature: GZ8MTXP02HVLLN.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgcccccaaattcaataatttatgaggtcactaagcggccctcaggggtccctgatcgcttcctctcgcctcaagctggcaacacggcctcccctgacccgtctctcgggctccgaggctggagatgagctgattattattgcagtctcatatgcgaggctagttacaatgtagtatagtttcgggacggtacgggaaacctaaaacgtcgtaacccgtcgtaaacggtcaacggcccgaaaggtccctacgtcccccgttcgg

SEQ ID NO: 323763 - DNA, 581 bp, Homo sapiens
  misc_feature: GZ8MTXP02IM2JD.4.39.D06.1.454.CMB.2.raw
  modified_base (305)..(305): a, c, t, g, unknown or other
  misc_feature (305)..(305): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatcctcctgcactggaaccagcagtgacgttggtcttataactatgtctcctggtaccaacaacacccaggacaaacgccccaaattcataatttangagtcactaagcgccctcgaggggtccctgtattcgcttcctctcgcctacaaggctggccaaacgaccggccctccctgacccgtctcgtcgggtcctacccgaggccgtaggaggatggaaggcgttaggtatttagtttaattggacctagtctactatactgactaggctagtacaagtgtagtaatgttacggacggaaacgggaacctaaaacgtcgtaacccgttccgtaacggtcaacgcccgaaaggtcctaccgtcccccgtccgg

SEQ ID NO: 323764 - DNA, 571 bp, Homo sapiens
  misc_feature: GZ8MTXP02HRFQ9.4.39.D06.1.454.CMB.2.raw
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctggtaccaacaacacccaggcaaacgcccccaaattcataatttatgaggtcactaagcggccctcaggggtccctgatcgcttcctctcgcctcaaggcctggccaacacggccctccctgacccgtctcgtgggcctccgaggctggagatgaggctagtattattattgcagtctcatatgcaggcagtttacaagttgtagtacttaagttcggggacggtaagggggtaacccaaaacgttcggaacccgttaccgtaagggtaccaacggaccccgaaaggtcccgtaccgtccccccgttccgg

SEQ ID NO: 323765 - DNA, 547 bp, Homo sapiens
  misc_feature: GZ8MTXP02GLF29.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgtttggtcgttataactatgtctcctggtaccaacaacacccaggcaaagcccccaaatcataatttatgagtcactaagcgccctcgaggggtccctgatcgcttcctctcgcctccaaggcctgggccaacacggcctccctgacccgtctctgggcctcccgagtctggacgatgaggctagatttattagttgcagtctacatatcgcgaggctaagttacaagtgtgaattagttacgggcggaaagggaccaaaacgtcgaccgtacgtaaggtacacgacccgaaggcctcgacccccgttcgg

SEQ ID NO: 323766 - DNA, 554 bp, Homo sapiens
  misc_feature: GZ8MTXP02FUJWA.4.39.D06.1.454.CMB.2.raw
  modified_base (304)..(304): a, c, t, g, unknown or other
  misc_feature (304)..(304): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttaataactatgtctcctggtaccaacaacacccagacaaacgccccaaatcaatattangagtcactaagcgccctcgacgggtccctgatcgcttcctctgcctcaagctggcaacacggcctccctgacccgtctcgtcgggcctccgaggctggagatgagctgattattattgctagctcatatgcaggctaagttacaagtgtagtaatagttcgggacggaaacgggaacctaaaacgttacgacccgttaccgtaagggtccaacggtacccccgaaaggtcctaccggtacccccgttcgg

SEQ ID NO: 323767 - DNA, 582 bp, Homo sapiens
  misc_feature: GZ8MTXP02ISG8I.4.39.D06.1.454.CMB.2.raw
  modified_base (283)..(283): a, c, t, g, unknown or other
  misc_feature (283)..(283): n is a, c, g, or t
  modified_base (299)..(299): a, c, t, g, unknown or other
  misc_feature (299)..(299): n is a, c, g, or t
  modified_base (356)..(356): a, c, t, g, unknown or other
  misc_feature (356)..(356): n is a, c, g, or t
  modified_base (436)..(436): a, c, t, g, unknown or other
  misc_feature (436)..(436): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctctgtaccaacacaccagacaaacnccccaaatcatattangagtcatagcgccctcgagggtccctgatcgtcttctctcgcctccagcctgcaacncggccctccctgaccgtctcgtgggctcgagctggagtatcggaggtctagtattatttagttgacagtcctctagttancgacaggtcctaaagtttacaaagttgtagtaatttacggttccggggacggggtaaaaccgggtaacctaaacgtaccggttacccgttacccgtaagggtccaaccggtacccgtaaagggcccttcccggtacccccgttcgg

SEQ ID NO: 323768 - DNA, 577 bp, Homo sapiens
  misc_feature: GZ8MTXP02GUBB9.4.39.D06.1.454.CMB.2.raw
  modified_base (228)..(228): a, c, t, g, unknown or other
  misc_feature (228)..(228): n is a, c, g, or t
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
  modified_base (402)..(402): a, c, t, g, unknown or other
  misc_feature (402)..(402): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttataactatgtctctggtaccaacaacaccagcaaacgccccaaatcataatttangagtcatagcgccctnagggtccctgatcgcttcctctcgcctcaaggctagggccaacgcggccctccctcgaccgtctcgtgggcctccgaggctggagntgaggtctgatttattagttgactacgtctactattagtcgacgtacgggctaaacggttacaaagttgtagtaagttaggttccggggacggtacggggtaaacctaaacgtcggaaccccgttcgtaacggtaccgaacgaccccgaaggtccctacccggccccgttcccgg

SEQ ID NO: 323769 - DNA, 548 bp, Homo sapiens
  misc_feature: GZ8MTXP02IEO2I.4.39.D06.1.454.CMB.2.raw
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttanaactatgtntctgtacaacaacaccagcaaanccccaaatacanaatttatnagtnactaanggccctcagggtcctgatcnctctctncncagcngcaacacgcctcctcgacgtctctgcgtccgacgcgtgagagtgagcgtgtattattattagtcacgtactctatatgacgaggacgtaacgttaacgtaaagtagtagtagttagttacggtacgggaacgggaaaccgaaaaccgtaacgtaaccgtaccgtaacggtacgacgaccgaacggaccgtaccgtccccgtccg

SEQ ID NO: 323770 - DNA, 585 bp, Homo sapiens
  misc_feature: GZ8MTXP02G9BF2.4.39.D06.1.454.CMB.2.raw
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactntgtctctgtacaacacaccagacaacgccccaatcatattangagtcactaagcgccctcgacgggtccctgactcgtcttcctctcgcctaccgaaggctacggaccaaccgaccggtcccttcccgtacgtacccgttcctcggtcgggccctacccgaggtccgtaggaggtagtcggaggtctagtatttattagttcgactagtctactagttacgagcgtaggtactaaggttacaagtgtagtagttacgttcggggacggtaaaggacctaaacgtcgtaccgtcgtaagtccgaacgtaccgaacgcctaccgccccgtacg

SEQ ID NO: 323771 - DNA, 551 bp, Homo sapiens
  misc_feature: GZ8MTXP02HK0QD.4.39.D06.1.454.CMB.2.raw
  modified_base (302)..(302): a, c, t, g, unknown or other
  misc_feature (302)..(302): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagttgacgttggtcgttataactatgtctctggtaccaacaacaccagcaaacgccccaaattcataattangagtcactaagcgccctcgacgggtccctgatcgcttcctctcgcctcaaggctggccaaacacggccctccctcgaccgtctcgtgggcctcccgaggctgagatggagctgtattattattgcagtctacatatgactaggctaagttacaagtgtagtattagttcgggacggtaacgggaacctaaacgtcgtaacccgtcgtaacggtcaacggaccccgaaggccctccgtacccccgttcgg

SEQ ID NO: 323772 - DNA, 553 bp, Homo sapiens
  misc_feature: GZ8MTXP02JN2HD.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagcaaacgccccaaatcataattatgagtcactaagcgccctcgaggggtccctgatcgcttcctctcgcctccaaggctggcaaccgacggccctcccgtgacccgtctcgtcgggcctcccgaggctgaggatggagtctgatttattattgacagtctacatatgacaggactaagttacaatgtagtagtacgttcgggacggtacggaacctaaacgtcgaacccgttcgtaaggtacaacgacccgaaggccctaccggcccccgttcgg

SEQ ID NO: 323773 - DNA, 577 bp, Homo sapiens
  misc_feature: GZ8MTXP02G15BT.4.39.D06.1.454.CMB.2.raw
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagcaaacgccccaaatcataattatgagtcactaagcgccctcgacggggtccctgactcgtcttccctctcgcctaccaaggcctggccaacgaccggtccctacccgtcgtacccgtctccgtcgggcctccgaggtctggaggatggacgtctagtatttagttagttgctagctnattangctaggactaagtttacaagttgtagtagttacgttcgggacggaacgggaaccaaaacgtcgaaccgttacgtaacggtactacggtccgaaacggtccgtccgacccccgtcgg

SEQ ID NO: 323774 - DNA, 623 bp, Homo sapiens
  misc_feature: GZ8MTXP02JO8M0.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagacaacgccccaattcataattatgagtacactaagccgccctcgacggggtccctgactcgtcttcctctcgccctacgaaggctggccaaaccgaccggccctcccgtcgacccgtctcgtcgggccctccgaggtctggagactggaggtctagtatttaattagttgacgagtctactattagtgaccaagggtacctaaggtttaacaaagtttggtacgtaaagttacggttcggggaccggggtaaacggggaaccctaaaacgtcggtaaccccgttaccggttaacggtccgaacggacccccgtaaagggcccgttacccggcccccggttccgg

SEQ ID NO: 323775 - DNA, 669 bp, Homo sapiens
  misc_feature: GZ8MTXP02HA4FS.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacaacacccaggcaaacgccccaaattcataattatgagtcactaagcggccctcgacggggtccctgatcgcttcctctgcctccaaggcctggccaacgaccggccctccctcgaccgtctcgtcggggcctcccgagggccttaggacggtagtacggacggtacttaggtaatttaagtttatttacggaccgtacggtcttactaagttaagtcggaccgtaacggggtacctaaaaggtttaacctaaagttacggttaggttaaagttacgggtttacgggggaaccggggttaaaccggggaaacccgtaaaaccgttccggtaaaccccggttaccgtaacggtacccgaacggtacccccgaaggtcccgtacccgtcccccgtttaccggg

SEQ ID NO: 323776 - DNA, 627 bp, Homo sapiens
  misc_feature: GZ8MTXP02IEOK2.4.39.D06.1.454.CMB.2.raw
  modified_base (227)..(227): a, c, t, g, unknown or other
  misc_feature (227)..(227): n is a, c, g, or t
  modified_base (302)..(302): a, c, t, g, unknown or other
  misc_feature (302)..(302): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctcctcgctccaggtctcctggacagtcagtcaccatctcctgcactggaaccngcagtgacgtttggtcgttataactatgtctctgtaccaacaacaccagacaacgaccccaattcattaatttangagtcaactagcgccctgacgggtccctgactcgccttctctcgccctacgaacggctcgggacctaacgacccgggtccctccccgtcgacccgttcctccgtcgggcccttccgaggtccgtgagggtactgggacgggtcttagtatttaagtttattcggactagtcctatattagtacgacgtaggacttaagttaactaaagttgtagtagttacggttacgggacgggaacgggtaaccctaaaacggttccgaaacccggttccgttaacggtacgaaaccggtaccccgtaacggggtcctacccggtccccccgg

SEQ ID NO: 323777 - DNA, 568 bp, Homo sapiens
  misc_feature: GZ8MTXP02INUGU.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaaacaacaccccaggccaaacgccccaaattcaataatttatgaggtacactaacgcggccctcgacggggtcccctgactcgtcttcctctcgcctccaaggtctggcaaccgacggccctcctcgaccgtctcgtcgggctccgagctgaggatgagtctgatttattattgcagtcacgtatatgcaggctagttaacaagtgtagtacgtagttcggacgggtaagggaaccctaaaacgtcgaaccccgttacgtaaggtaccacggaccccaagggtcctaccgaccccgttcgg

SEQ ID NO: 323778 - DNA, 584 bp, Homo sapiens
  misc_feature: GZ8MTXP02JDM0T.4.39.D06.1.454.CMB.2.raw
  modified_base (298)..(298): a, c, t, g, unknown or other
  misc_feature (298)..(298): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacacacccagcaaacgccccaatcatattangagtcactaagcgccctcgaggggtccctgactcgtcttcctctcgcctcagctggccaacaccggccctcccgtcgaccgtctcgtcgggcctccgaggctggaggatggaggctgtatttattagttgacagtctacattagtgcaggtctaagttacaagtgtagtagttacgttccgggacgggtaaacgggtaaaccctaaacgtaccggtaaccccgttaccgtaacgggtaccaaccgggtaccccgaaacggtccctacccggtccccccgtttacgg

SEQ ID NO: 323779 - DNA, 551 bp, Homo sapiens
  misc_feature: GZ8MTXP02GHCPH.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctgtaccaacaacacccaggcaaacgcccccaaattcataattatgagtcactaagcggccctcagggtccctgatcgcttcctctgcctccaagctggcaacgacggcctccctgaccgtctctgggctcccgagctgagatgaggctgattattattgactagtctactatatgcaggctaagttacaattgtagtatacgtttacggcgggtaacgggaacctaaacgtcggtaaccgttaccgtaaggttaccgacgtacccgaacggccttccgacccccgttccgg

SEQ ID NO: 323780 - DNA, 583 bp, Homo sapiens
  misc_feature: GZ8MTXP02GMPJQ.4.39.D06.1.454.CMB.2.raw
  modified_base (308)..(308): a, c, t, g, unknown or other
  misc_feature (308)..(308): n is a, c, g, or t
  modified_base (462)..(462): a, c, t, g, unknown or other
  misc_feature (462)..(462): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctggtaccaaacaacacccaggacaaacgccccaaattcataatttangagtcactaagcggccctgacggggtccctgactcgtcttcctctcgcctaccgaaggcctggccaaccgaccggtccctcccgtgacccgtctcgtcgggcctcccgaggctggaggatggaggctgatttagttattgacagtctacattangacgaggtcaagtttacaatggtataataggttcgggacggtaacgggaaccaaacgtcgaaccgttaccgtaagggttaccacgtacccgaaacggtccgtacccgtcccccgttaccgg

SEQ ID NO: 323781 - DNA, 562 bp, Homo sapiens
  misc_feature: GZ8MTXP02G0VQR.4.39.D06.1.454.CMB.2.raw
  modified_base (283)..(283): a, c, t, g, unknown or other
  misc_feature (283)..(283): n is a, c, g, or t
  modified_base (431)..(431): a, c, t, g, unknown or other
  misc_feature (431)..(431): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctctgtaccaacaacaccagcaaacnccccaaatcataattatgagtcactaagccgccctcgacgggtccctgatcgtcttcctctcgcctcaagctggcaaccacggccctcccgtcgaccgtctcgtggcctcgagctggagatgaggtctagattattagtgcagcctanatagtgacgtacggctaagtacgtaatggtagtaattacggttcgggacggacgggtaaaccaaacgttacggacccgtacgtaagggtaccaacggtacccgaagggtccctaccggaccccgtttccgg

SEQ ID NO: 323782 - DNA, 550 bp, Homo sapiens
  misc_feature: GZ8MTXP02HF5G7.4.39.D06.1.454.CMB.2.raw
  modified_base (229)..(229): a, c, t, g, unknown or other
  misc_feature (229)..(229): n is a, c, g, or t
  modified_base (298)..(298): a, c, t, g, unknown or other
  misc_feature (298)..(298): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcgttataactatgtctctgtaccaacaacaccagacaacgccccaatcatattangagtcataagcgccctcgacgggtcctgatgtcttcctctgcctcgaagctggcaacncggccctccngacctcncgtgctccgagctgagatgagtctgactttatattgatacgtctcgtatagtgcgaggctaagttaactaagtgtagtaacgttacgttcgggacgggaaacggtaacccaaaacgtcggtacccgtacgttaacggacgaaccggacccaagggtcctaccggtacccccgttcgg

SEQ ID NO: 323783 - DNA, 637 bp, Homo sapiens
  misc_feature: GZ8MTXP02G0G16.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttaataactatgtctcctgtaccaacaacacccagacaaacgccccaaattcataattatgagtcactaagccggccctcgacgggtccctagactcgtcttccctctcgccctaccgaaggctcggccaacgaccggtccctccctcgacccgtctcgtcgggcctccgaggtctggacggagtggagtctagtattagttattcgactacgtctactatatcggacagggtactaacgtttaacaagtttgtagtaacgttacggtttacggggacggggtaaacgggtaaacccgtaaaacgttccgggtaacccgttacccggttaacgggtaccgaacccggtacccgaaacgggtcccgttaccccgggtacccccgtttacccggg

SEQ ID NO: 323784 - DNA, 579 bp, Homo sapiens
  misc_feature: GZ8MTXP02GQQQU.4.39.D06.1.454.CMB.2.raw
  modified_base (424)..(424): a, c, t, g, unknown or other
  misc_feature (424)..(424): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgcccccaaattcataatttatgagtcactaagcggccctcgaggggtccctgatcgtcttcctctgcctccaaggccttcgggccaaacgaccggtccctcccgtgacccgtctccgtggggcctccgaggctggacgntggaggtctgatttattatgcagctcatatgcacgggtctaagtttacaagtggtagtaatacggtttcggacgggaaagggaaccctaaacgtaccggaccgttacccgtaaggtccaacggcccgaaacggccttccggaccccctttccggg

SEQ ID NO: 323785 - DNA, 565 bp, Homo sapiens
  misc_feature: GZ8MTXP02JQIJW.4.39.D06.1.454.CMB.2.raw
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
  modified_base (432)..(432): a, c, t, g, unknown or other
  misc_feature (432)..(432): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctgtaccaacacacccagacaaacgccccaaatcatattangagtcactaagcggccctcgacgggtccctgactcgcttcctctgcctcaggctggcaacgacgcctccngacccgtctcgtcgggcctccgagctgacggatggacgctagatttattattgacagtctnatatgcaggctaagttacaagttgtacgtaacgttacgtcgggacgggtaacgggaacctaaacgtacggtaaccgttaccgtaaggtaccgtaacgacccgaaacgggtccctaccggtcccccgttaccgg

SEQ ID NO: 323786 - DNA, 601 bp, Homo sapiens
  misc_feature: GZ8MTXP02IZMOP.4.39.D06.1.454.CMB.2.raw
  modified_base (302)..(302): a, c, t, g, unknown or other
  misc_feature (302)..(302): n is a, c, g, or t
  modified_base (513)..(513): a, c, t, g, unknown or other
  misc_feature (513)..(513): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtacgttataactatgtctcctagtacaacaacaccagacaaacgccccaaattcataattangagtcactaagcgccctcgacgggtccctgactcgtcttccctctcgtccctaccgaaggccttcggaccaaacgaccggtccccttaccccgtcgacccgttccgtcgttcgggccctccgacggcgtaggaacggtagtggaacggtctagtatttattagttcggactaggtcttacattagagaccgtaggctaagttacaagttgntaaagtgttaccgggacggtaaacggtacaaaacgtcgaacccgtacgtaacggtacacggacccgaaggccctccgtaccccttcgg

SEQ ID NO: 323787 - DNA, 639 bp, Homo sapiens
  misc_feature: GZ8MTXP02HB88W.4.39.D06.1.454.CMB.2.raw
  modified_base (299)..(299): a, c, t, g, unknown or other
  misc_feature (299)..(299): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctctgtaccaacacaccagacaaacgccccaatcataattangagtacactaagcggccctcgacggggtccctgactcgtcttcctctcgccctacaaggctcggccaaccgaccggccctcccgtcgtacccgtctccgtgggcctcccgaggctaggaggtatcggacggtcttagtaatttaagtttagttcggactaggtcctacgtaagtttagtcgaccgaagggtacctaaggtttaacctaaagtttggtaacgtaacgttaacggttccggggaacgggtaaacggggaaaccctaaaacgtcggtacccgttaccgtaacggtaccgaaccggtacccgaacggtcccgtacccggtacccccgttaccgg

SEQ ID NO: 323788 - DNA, 577 bp, Homo sapiens
  misc_feature: GZ8MTXP02IZ6XL.4.39.D06.1.454.CMB.2.raw
  modified_base (304)..(305): a, c, t, g, unknown or other
  misc_feature (304)..(305): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttaataactatgtctcctggtacaacaacaccagacaaacgccccaaatcataatttannagtcataagcgccctcgacgggtccctgactcgtcttcctctcgcctaccgaaggccttacgggcaaaccgaccggtccctcccccgtgacccgtctcgtgggcctccgagctgagatggaggctgattagttattgcagtnttacattancgacagactaagttacaagtgtagtaagtacggttcgggacggtaacggaaacctaacgtaccgtaccgttacgtaacggtacgaaccgtacccgaacggtcccgtccgtacccccgttcg

SEQ ID NO: 323789 - DNA, 583 bp, Homo sapiens
  misc_feature: GZ8MTXP02IWU23.4.39.D06.1.454.CMB.2.raw
  modified_base (305)..(305): a, c, t, g, unknown or other
  misc_feature (305)..(305): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatctcctgcactggaaccagcagtgacgttggtcttataactatgtctctggtaccaacaacacccagacaaacgcccccaaatcaataatttangaggtcactaagcgccctcgacgggtccctgactcgtcttcctctcgcctccgaagcctacggcaaccaccggcccttccctcgacccgtctcgtcgggctcccgagctggagatgagctagattattattgacagtctactatagtgacaggctaagttacaaagtgtagtattcggttacgggacgggaacgggaaacctaaacgtcggtaaccccgttaccgtaacgggtaccaacggacccctaaagggtccctacccggtaccccctttcggg

SEQ ID NO: 323790 - DNA, 576 bp, Homo sapiens
  misc_feature: GZ8MTXP02H76HN.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctctcactcagggcacagggtcctgggcccagtctgccctgactcagccctcctcgcgtccggtctcctggacagtcagtcaccatctcctgcactggaaccagcagtgacgttggtacgttataactatgtctcctggtaccaacaaccaccaggacaaacgccccaaatcataattatgagtcactaagccgccctcgacggggtccctgactcgtcttcctctcgcctaccgaaggcctggccaaccgaccggtccctcccgtgacccgtctcgtcgggcctccgaggcctaggaggataggaggctagtattagttattgcagtctacatacgtgacgaggtactaagtttacaattggtagtaattacggttaccgggacgggaacgggtaaacctaaacgtcgtaaccgtccgtaacggtcaacgtccgaacgtctcgaccccctcgg

SEQ ID NO: 323791 - DNA, 510 bp, Homo sapiens
  misc_feature: GZ8MTXP02GXHZ8.4.39.D06.1.454.CMB.2.raw
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaatcataatttatgaggtcactaagcggccctcaggggtccctgatcgcttcctctgcctcaagctggcaacacggcctccctgaccgtctctgggctccgaggctgagatgaggctgattattattgcagctcatatgcaggcagttacaatgtgatagttcggcggaagggaccaaacgtcgaccgtctaaggtcacgtccaaggcctcgcccctcgg

SEQ ID NO: 323792 - DNA, 545 bp, Homo sapiens
  misc_feature: GZ8MTXP02GY6J0.4.39.D06.1.454.CMB.2.raw
  modified_base (300)..(300): a, c, t, g, unknown or other
  misc_feature (300)..(300): n is a, c, g, or t
  modified_base (442)..(442): a, c, t, g, unknown or other
  misc_feature (442)..(442): n is a, c, g, or t
  modified_base (533)..(533): a, c, t, g, unknown or other
  misc_feature (533)..(533): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacacacccagcaaacgccccaaatcataattangagtcactaagcgccctcgacggggtccctgatcgcttcctctcgcctcaagctggcaacacggccctcctgaccgtctctcgggcctccaggctgacggatgaggctagtatttattagttgacagtctacatatgcaggntaagttaacaagtgtagtattacgttcgggacggaacgggaacctaaacgtcgtaacccgttacgtaaggtccacggacccgaaggtcccncccgtcccgtcg

SEQ ID NO: 323793 - DNA, 537 bp, Homo sapiens
  misc_feature: GZ8MTXP02JVZJD.4.39.D06.1.454.CMB.2.raw
  modified_base (307)..(307): a, c, t, g, unknown or other
  misc_feature (307)..(307): n is a, c, g, or t
  modified_base (432)..(432): a, c, t, g, unknown or other
  misc_feature (432)..(432): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaatacccaggacaaacgcccccaaattcataatttangagtcactaagcgccctcgaggggtccctgatcgtcttcctctgcctccaaggctggcaacacggcctccctgaccgtctcgtcgggctcccgaggctggaggatgaggctagatttatattganagctacatatgacaggcagttacaagtgtgtatagttcgggacggaagggaaccaaaacgtcgacccgttacgtaaggtcaacgcccaaggcctcggccccctgg

SEQ ID NO: 323794 - DNA, 552 bp, Homo sapiens
  misc_feature: GZ8MTXP02GM4DX.4.39.D06.1.454.CMB.2.raw
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgccccaaatcataatttatgagtcactaagcggccctcacggggtccctgatcgtcttcctctgcctccaaggctggcaacacggcctccctgacccgtctcgtggggccttcccgagggcctggacggatggaggctagatttattattgacngtctnatatgcaggctaagttacaatgtagatcgttacgggacggtaagggaaccaaacgtcgtaacccgtcgtaacggtcacggacccgtaaggcctccggacccccttcgg

SEQ ID NO: 323795 - DNA, 575 bp, Homo sapiens
  misc_feature: GZ8MTXP02IL7UM.4.39.D06.1.454.CMB.2.raw
  modified_base (228)..(228): a, c, t, g, unknown or other
  misc_feature (228)..(228): n is a, c, g, or t
  modified_base (299)..(299): a, c, t, g, unknown or other
  misc_feature (299)..(299): n is a, c, g, or t
  modified_base (414)..(414): a, c, t, g, unknown or other
  misc_feature (414)..(414): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccngcagtgacgttgtcgttataactatgtctctgtaccaacacaccagacaaacgccccaaatcataatttangagtacactaagccgtccctcgacgggtccctgatcgtcttcctctcgcctacaggtcctggccaacaccggtccctccccgtcgtacccgtctcgtgggcctccgagctggagntggaggtctagtattattagttgcagtctacatacgtgacacggtactagttaacaagttgtataagttacggttacgggacggaacgggaaccctaaaacgtcggaaccgttcgtaaaggccacggtaccccgaaggtcccgtaccgtacccccgttcgg

SEQ ID NO: 323796 - DNA, 532 bp, Homo sapiens
  misc_feature: GZ8MTXP02FWKGN.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactatgtctctgtaccaacaacacccagcaagccccaaatcataattatgagtcactaagcgccctcgaggggtccctgatcgtcttcctctcgcctccaaggctggcaacacggcctccctgaccgtctcgtcgggctccgagctgagatgagctgattattattgcagtctcaatatgcaggctagttacaagtgtgaattgttcggacggaagggaacctaaacgtacgaccgttaccgtaaggtccaacgacccaagggtcctccggtcccccgttacgg

SEQ ID NO: 323797 - DNA, 569 bp, Homo sapiens
  misc_feature: GZ8MTXP02HNB0Z.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaaccagcagtgacgttggtcgttataactatgtctcctggtaccaacaacacccaggacaaacgccccaaattcataattatgagtcactaagcgccctcgacggggtccctgactcgcttcctctcgcctcaaggctggcaaacacggcctccctgacccgtctcgtgggcctccgaggctaggaggtactggaggtctagtatttattattgacagtctacatatgacaggactaagttacaagtgtagtatagttcgggacggaacgggaaacctaaaacgtcgtaacccgtaccgttaaggtaccaacggacccgaagggtccctcccggtacccccgtccgg

SEQ ID NO: 323798 - DNA, 613 bp, Homo sapiens
  misc_feature: GZ8MTXP02I7KIT.4.39.D06.1.454.CMB.2.raw
  modified_base (304)..(304): a, c, t, g, unknown or other
  misc_feature (304)..(304): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacagccacgagacaaccgaccctatcaattaattanagtagtactaacgacgcccgtcctaggtaccgggtctagacgtccgtccttctcgtcacccagacgtcgcggaccaaaccggccgtccctccgtacgtacccgttctcggcgtccctcgacggtctgggaagtcgtaggacgtctagttatttattcgtggactcgtctagttaatacgtcgacgcggtaacgtacgttaaatagttgtaacgtacgttacggtacgggaacggtaaaccgtaaacctaacggtccgtaacccgtaacggtacgaaccgaccggtaaccgacgtcccgtacccgtcccg

SEQ ID NO: 323799 - DNA, 564 bp, Homo sapiens
  misc_feature: GZ8MTXP02F04HL.4.39.D06.1.454.CMB.2.raw
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
  modified_base (420)..(420): a, c, t, g, unknown or other
  misc_feature (420)..(420): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaaacaacacccagacaaacgccccaaatcaataatttangagtcactaagcgccctcgacgggtccctgatcgcttcctctcgcctcaagctggcaacncggccctcctgacctcnctggctccgagctgagatggagctgtattattagttncagctacatatgacgaggactaagttacaagttgagtattacgttacgggacgggaaacggtaaacccaaaacgttcggacccggttactaacgggttccaaaccggaccccgaaaggtccgttacccgcccccgtttacccgg

SEQ ID NO: 323800 - DNA, 603 bp, Homo sapiens
  misc_feature: GZ8MTXP02GGBL6.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggaaccagcagtgacgttggtcgttataactatgtctcctggtaccaaacaacacccaggacaaacgaccccaaatcataattatgagtcactaagcggccctcgacggggtccctgatcgcttcctctcgtcctccaaggcctggccaacaccggtcctcccgtagacccgtctcgtcgggcctccgagctgagatggagctgtattattattgacagtctctaatagtcgacgaggtactaagtttacgaaattgtagtaattacggttaccggggacgggaaacggggaaccctaaacgtacggtaaccccgttaccgtaaacgggttccaaacggacccccgtaaaggggcccttacccgggtacccccgtttcccgg

SEQ ID NO: 323801 - DNA, 511 bp, Homo sapiens
  misc_feature: GZ8MTXP02JEO5E.4.39.D06.1.454.CMB.2.raw
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (405)..(405): a, c, t, g, unknown or other
  misc_feature (405)..(405): n is a, c, g, or t
  modified_base (452)..(452): a, c, t, g, unknown or other
  misc_feature (452)..(452): n is a, c, g, or t
  modified_base (477)..(477): a, c, t, g, unknown or other
  misc_feature (477)..(477): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccaggtcctcctggacagtcagtcaccatctcctgcactggaaccagcagtgacgtttggtcgttataactatgtctcctggtaccaacaacaccaggcaaacgccccaaattcataatttangagtcactaagccgcctcgacgggtccctgactcgccttctcncncctcaagctggcaacgacgccctcctgaccgtctctcggctccgaggctgagntgagctgattatatgcagctacatatgacagctagttacaagtgtanagttatcggaggacggactaaacgngaccgtctaggtcacgccgaacgctcgacccccg

SEQ ID NO: 323802 - DNA, 570 bp, Homo sapiens
  misc_feature: GZ8MTXP02JHP6O.4.39.D06.1.454.CMB.2.raw
  modified_base (302)..(302): a, c, t, g, unknown or other
  misc_feature (302)..(302): n is a, c, g, or t
  modified_base (448)..(448): a, c, t, g, unknown or other
  misc_feature (448)..(448): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctggtaccaacacacccagcaaacgccccaaatcataattangagtcactaagcggccctcgagggtccctgatcgtcttcctctcgccctccaaggctcgggccaaaccgaccggccctaccctgacccgtctccgtgggcctcccgaggctggagatcggagtctgatttattattgctagtcctntatagtgacgtaggcctaaggttacaagttgtagtattacgttcgggacgggaacggtaacctaaaacgtcgtaacccgtcgtaacggtccacgacccgaacggtcctaccggcccctacgg

SEQ ID NO: 323803 - DNA, 567 bp, Homo sapiens
  misc_feature: GZ8MTXP02FMHUC.4.39.D06.1.454.CMB.2.raw
  modified_base (301)..(301): a, c, t, g, unknown or other
  misc_feature (301)..(301): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttgtcgttataactatgtctcctgtaccaacaacacccaggcaaacgccccaaattcataattangagtcactaagcggccctcgagggtccctgactcgcttcctctcgcctccaaggctggcaacgacgcctccctgaccgtctctcgggcctccgaggctacgaggtatggagctgtattattagttgcagtctactatatgcaggctaagttacaaagttgtagtaagttagttccgggacggtaaacggggaacctaaaacgtccgaacccgttaccgtaagggtcgaaccggccccgaaaggtccgtaccgtacccccgtccggg

SEQ ID NO: 323804 - DNA, 700 bp, Homo sapiens
  misc_feature: GZ8MTXP02G3IYD.4.39.D06.1.454.CMB.2.raw
  modified_base (252)..(252): a, c, t, g, unknown or other
  misc_feature (252)..(252): n is a, c, g, or t
tcagagcactgtagcacgaccggtgctcgatttagtgacatctcgcagttctttgggttttgggggaagtgtggtacggcctggggggtccctgagactctcctgtacagcctctggattctcctttgatgattatggcatgagctgggtccgccaagctccgaggggaaggggctggagtgggtgtctggtatgaattggagtggcggtagtacagcttatgcagactctgtgaagggccattcaccatcncagagacaacgccaaagactccctgtatctgactaattgaaacagtctgagagccgaggacacggctttgtattactggtgacgagtaactagtttaggggtgttaggtagtaggtaacagtcctgcttagtttcgtcgtacgttgggggtttcgacgttacggtcgggggtaccgagggggacgtcccgttcggtccctacccggttcctcccgtaccgacgtccccgttacccgaacccggaacggggcccctaacgttccccgggttccccctttcccccccggcgggtcccccgtccccgtccggtacccgtacccggacgggaccgaccccgtacccggtacccggacggaccgacccgaacccggtaccggccccggtccccgggtcggggtcccgtccggtcccggttcgggtaaccgtaaccgggtaaccctttaccccg

SEQ ID NO: 323805 - DNA, 535 bp, Homo sapiens
  misc_feature: GZ8MTXP02FEKPW.4.39.D06.1.454.CMB.2.raw
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
  modified_base (456)..(456): a, c, t, g, unknown or other
  misc_feature (456)..(456): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgtttggtcttataactatgtctcctggtaccaacaacacccaggcaaacgccccaaattcataatttatgagtcactaagcggccctcaggggtccctgatcgcttcctctgcctcaaggctggcaacacggcctccctgaccgtctctcgggctcccagggctgaggatgaggctgattatattgcagcctanatangacgagactagtaacagtgtanagtagtcgggacggaacggaaccaaacgtccgaccgtaccgtaacgtacgacgacccgacggtccgtcccgccccgtcg

SEQ ID NO: 323806 - DNA, 596 bp, Homo sapiens
  misc_feature: GZ8MTXP02HK296.4.39.D06.1.454.CMB.2.raw
  modified_base (298)..(298): a, c, t, g, unknown or other
  misc_feature (298)..(298): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttgtcgttataactatgtctctgtaccaacacaccagacaaacgccccaaatcataattangagtcactaagcgccctcgacgggtcctgactcgtcttcctctcgcctacgaaggctggccaacgaccggtccctcccgtcgtacccgtctcgtcgggcctccgaggctaggaggatggaggcttagtatttattagttgactagtctacatagtgacgtaggactaagttaacgaagttgtagtaacgttacggttacggggaacgggtaaacgggaaaccctaaaacggtccggtaacccgttacggtaacggtaccaacggtacccgaacggtcccgtccggtacccccgttcgg

SEQ ID NO: 323807 - DNA, 596 bp, Homo sapiens
  misc_feature: GZ8MTXP02HY75R.4.39.D06.1.454.CMB.2.raw
  modified_base (231)..(231): a, c, t, g, unknown or other
  misc_feature (231)..(231): n is a, c, g, or t
  modified_base (303)..(303): a, c, t, g, unknown or other
  misc_feature (303)..(303): n is a, c, g, or t
  modified_base (330)..(330): a, c, t, g, unknown or other
  misc_feature (330)..(330): n is a, c, g, or t
  modified_base (464)..(464): a, c, t, g, unknown or other
  misc_feature (464)..(464): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggaaccngcagtgacgttggtcttataactatgtctctgtaccaacaacaccagacaaacgccccaaatcataatttangagtcataagcgccctgacgggtcccngactcgtcttcctctcgcctaccgaaggtctcggcaacgaccggtccctccccgtcgacccgtctccgtcgggcctccgaggctaggaacggtatcggagtctagtatttattattgactagtctacgattagngacgaggtctaagttacaagtgtagtaacgttacggttacggggacggtaacgggaaaccctaacgtacggtaacccgttacgtaacggtaccaacggacccgaaggtcccttacccggacccccgtttcgg

SEQ ID NO: 323808 - DNA, 514 bp, Homo sapiens
  misc_feature: GZ8MTXP02FR722.4.39.D06.1.454.CMB.2.raw
  modified_base (451)..(451): a, c, t, g, unknown or other
  misc_feature (451)..(451): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgagtcactaagcggccctcaggggtccctgatcgcttcctctgcctccaaggctggcaacacggcctccctgaccgtctcgtgggctccgaggctggagatgagctgattattattgcagctcatatgcaggctagttacaatgtnatgttcggcggtacggacaaacgtcgaccgtctaaggtcacgcccaaggcctacgccccgtcg

SEQ ID NO: 323809 - DNA, 556 bp, Homo sapiens
  misc_feature: GZ8MTXP02GBP8M.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagcaaacgcccccaaattcaataattatgagtcactaagccgccctcgacgggtccctgatcgcttcctctgcctcaagctggcaacgacgccctccctcgaccgtctcgtcgggcctcccgaggctggacggatggaggctagattattattgcagctacatatgcgaggcctaagttacaagtggtagattaggttccgggacggaacgggacctaaaacgtcggacccgttaccgtaaggtccaacggaccccaaggcctaccgcccccgttacgg

SEQ ID NO: 323810 - DNA, 606 bp, Homo sapiens
  misc_feature: GZ8MTXP02F026Y.4.39.D06.1.454.CMB.2.raw
  modified_base (300)..(300): a, c, t, g, unknown or other
  misc_feature (300)..(300): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttaataactatgtctcctgtaccaacaacaccagacaaacgccccaatcataattangagtcactaagccgccctcgagggtccctgactcgtcttcctctcgcctcgaaggcctggccaaaccgaccggccctcccctacgacccgtcgtcgtcggggccttcccgaggcctggaagtatggaggtctagtatttattattgactagtctactatagtcgacgtaggactaagttaacaagttgtagtaagttacggttccggggaacggtaaacgggaaacctaaaacggttcgtaacccggttacgttaacggtaccgaacggaccccgtaacgggtccctaccggtacccccgtttcgg

SEQ ID NO: 323811 - DNA, 584 bp, Homo sapiens
  misc_feature: GZ8MTXP02GHR70.4.39.D06.1.454.CMB.2.raw
  modified_base (300)..(300): a, c, t, g, unknown or other
  misc_feature (300)..(300): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacaacaccagcaaacgccccaaatcataattangagtcataagcgccctcgaggggtccctgatcgcttcctctcgcctccaaggcctgggccaaacaccggccctcccgtcgacccgtctcgtcgggcctcccgaggctgaggatggaggctgtattattatgcagtctacatatcgacgaggctaagtttaacaagtgttaagtagttaacgttcggggacgggtaaacgggaaccctaaaacgtcggtaacccgttacccgtaagggtaccaacggtaccccgaaagggtcctacccggtacccccgtttcggg

SEQ ID NO: 323812 - DNA, 586 bp, Homo sapiens
  misc_feature: GZ8MTXP02JZ6YG.4.39.D06.1.454.CMB.2.raw
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacaacacccaggcaaacgccccaaattcataatttatgagtcactaagcggccctcgaggggtccctgatcgcttcctctcgcctaccaaggctgggccaaacgaccggccctccctcgacccgttctccgtcggggccttcccgagggtcctggaggactggaggcttagatttattattgctagcctanatangcgaggtctaagttaactagtgtagtacttacggtacggggacgggtaacggaaacctaaacgtccggtaaccgtacgtaacggtacgaccggacccgtaacggtccctcccgacccccgttcg

SEQ ID NO: 323813 - DNA, 567 bp, Homo sapiens
  misc_feature: GZ8MTXP02F6RE1.4.39.D06.1.454.CMB.2.raw
  modified_base (300)..(300): a, c, t, g, unknown or other
  misc_feature (300)..(300): n is a, c, g, or t
  modified_base (452)..(452): a, c, t, g, unknown or other
  misc_feature (452)..(452): n is a, c, g, or t
  modified_base (473)..(473): a, c, t, g, unknown or other
  misc_feature (473)..(473): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggaaccagcagtgacgttggtcttataactatgtctctgtaccaacacaccagacaaacgccccaaatcataattanagagtcactaagcgccctcgacgggtccctgatcgtcttccctctcgcctaccaaggtcctagggccaaccgaccggcccttccccgtgaccgtctcgtcgggctccaggctgagatgaggctgattattattgcagtctactaatatcganaggtctaagttacaagtgtanattagttcgggacgggaaggaaacctaaacgtacggacccgttaccgtaacggtaccaacggacccgaaggtcctacccggcccccgtttacgg

SEQ ID NO: 323814 - DNA, 539 bp, Homo sapiens
  misc_feature: GZ8MTXP02GZQSB.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgccccaaattcataatttatgagtcactaagcggccctcaggggtccctgatcgcttcctctgcctccaaggctggcaacacggcctccctgaccgtctctgggcctccagctgagatgagctgattattattgcagctcatactgcaggcaagttacaaatgtagtatagttcgggacggaacgggaaccaaaacgtcgaacccgttcgtaacgggtcacggaccccgaaggcctaccggtcccccgtccgg

SEQ ID NO: 323815 - DNA, 545 bp, Homo sapiens
  misc_feature: GZ8MTXP02FOJ28.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagcaaacgcccccaaattcataattatgagtcactaagcgccctcaggggtccctgatcgcttcctctgcctccaaggctggcaacacggcctccctgaccgtctctggggcctccgaggctgaggatggaggctgattattattgcagctcatatgactaggctagttacaattgtagtactagttcgggacggaagggaacccaaaacgtcgaacccgttccgtaaggtaccacggaccccgaaggcctccgccccccgttccggg

SEQ ID NO: 323816 - DNA, 567 bp, Homo sapiens
  misc_feature: GZ8MTXP02GZW4N.4.39.D06.1.454.CMB.2.raw
  modified_base (299)..(299): a, c, t, g, unknown or other
  misc_feature (299)..(299): n is a, c, g, or t
  modified_base (446)..(446): a, c, t, g, unknown or other
  misc_feature (446)..(446): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttaataactatgtctctgtaccaacaacaccagcaaacgccccaaatcatattangagtcactaagccggccctcgacgggtccctgactcgtcttcctctcgccctcgaaggtctgggccaaaccgcggccctcccgtcgaccgtctcgtggcctccgagctggacggatggaggtctagtattatttagttgcagtcctnattatcgacaggctaagttacaagtgtagtattaggttcgggacggaacgggaaacctaaacgtcgaacccgttacgtaacggtcaacggacccgaagccgttacccgaccccgtttccgg

SEQ ID NO: 323817 - DNA, 571 bp, Homo sapiens
  misc_feature: GZ8MTXP02IXY0K.4.39.D06.1.454.CMB.2.raw
  modified_base (525)..(525): a, c, t, g, unknown or other
  misc_feature (525)..(525): n is a, c, g, or t
tcagagcactgtagcacgaccggtgctcgatttagtgacatctcgcagttctttggggagctctgggagaggagccccagccctgagattcccacgtgtttccattcagtgatcagcactgaacacagaggactcgccatggagtttgggctgagctgggttttccttgttgtcttaattttaaaggtgtccaatgtgaggtgcaactggtggagtcgtgggggaagtgtggtacggccgtgggggtcctgagactctcctgtacagcctctggattctccttgatgattatggcatgagcgtgggtcccgccaagctccgaggggagggctgggagtgggtgtcgtggtatgtaagttgggagtgggcggtagtacgagtcttatgcagactgtgtaggaacgggcctattccgactatccacaagacgacaaacgccaaagtacctccctagtactccagactaattagaactagttcaggacgacggccggaaggaccgtacggtcctttagaactttacgnggtaacgacgaagtaaacgttagtttacggggtagttacgttaagg

SEQ ID NO: 323818 - DNA, 586 bp, Homo sapiens
  misc_feature: GZ8MTXP02IJQBO.4.39.D06.1.454.CMB.2.raw
  modified_base (304)..(304): a, c, t, g, unknown or other
  misc_feature (304)..(304): n is a, c, g, or t
  modified_base (331)..(331): a, c, t, g, unknown or other
  misc_feature (331)..(331): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctctcactcagggcacagggtcctgggcccagtctgccctgactcagcctccctcgcgtccgggtctcctggacagtcagtcaccatctcctgcactggaaccagcagtgacgttggtcgttaataactatgtctcctggtaaccaacaacacccagacaaacgaccccaaatcataattangagtcactaagcgcctcgagggtcccngatcgcttcctctgcctcaaggctggcaacgaccggccctccctacgaccgtctcgtacgggcctccgaggtcgtgaaggattggaacggtctagtatttaacttatttgactagtcctatatatcgactaggactaggttaaatagtgtagtacgttacggtcgggaacggtaaacggtaacctaaacgtcggtaaccgtaccgtaacggtaccgaacggtacccgaacggtcccgtacccggtacccccgtcg

SEQ ID NO: 323819 - DNA, 640 bp, Homo sapiens
  misc_feature: GZ8MTXP02FNM9X.4.39.D06.1.454.CMB.2.raw
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactgtcgttataataatgtctctcggtacaaccaacaacccacgacgaacaaccccaacctaatacaaatttaattagaggtacgactaaacgtaacggccccgtccctaggggtacccggttccgagtacgtccttcctttcctcgtcctacccaacggacgtcggcgaaaccaaaccggcccgtccccctccgtaccggtccttccgttggggcgtcccctaggacgtgagggagtgngggacttntaattaatttattgacactacgtactaataatgcgagacgtattaataatgtgtaagtacgttacggggacgggaacgggaaacctaaaaccgtacgtcccggttaccgtaacgtacgaacgaccccgaacggtaccgtccccgtaccccgtacccg

SEQ ID NO: 323820 - DNA, 576 bp, Homo sapiens
  misc_feature: GZ8MTXP02F81ZO.4.39.D06.1.454.CMB.2.raw
  modified_base (300)..(300): a, c, t, g, unknown or other
  misc_feature (300)..(300): n is a, c, g, or t
  modified_base (480)..(480): a, c, t, g, unknown or other
  misc_feature (480)..(480): n is a, c, g, or t
tcagagcactgtagcacgaccggtgctcgatttagtgacatctcgcagttctttgggggggtctcaggaggcagcgctctcaggacgtcaccaccatggcctgggctctgctcctactcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacaacaccagacaaacgccccaaatcaatattangagtcatagccgccctcgacgggtccctgatcgtcttcctctcgcctaccgaagcctggccaaacgccggtccctacccgtcgaccgtctcgtcggcctccgaggtctaggacgtatcggaggtctagtatttaatttagttcggactaagtcctatagtatcgacaggtctaagttaanagttgtagtacgttacggtacgggacggtaaacgaaacctaacgtccgtaccgtacgtaacgtaccgacgaccgtacggtcctccgtaccccgtcg

SEQ ID NO: 323821 - DNA, 603 bp, Homo sapiens
  misc_feature: GZ8MTXP02HSBDG.4.39.D06.1.454.CMB.2.raw
  modified_base (300)..(300): a, c, t, g, unknown or other
  misc_feature (300)..(300): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtacgttataactatgtctctgtaccaacacaccagcaaacgccccaatcataattangagtcactaagccgccctcgagggtccctgtactcgcttcctctcgccctacgaaggtcctgggcctaaaccgaccggcccttccccgtagaccccgttctccgtcggggcctccgaggcctggagtacgtggagtctagtatttattattgctagtctacatactgacgaggtactaggttaactagttgtagtacgttacggtttcgggacgggtaacgggtaaaccctaaacgtccggtaacccgtacgtaacggtaccgaaccggtacccgaaggcccgtcccggtacccccgttccgg

SEQ ID NO: 323822 - DNA, 603 bp, Homo sapiens
  misc_feature: GZ8MTXP02I1XU5.4.39.D06.1.454.CMB.2.raw
  modified_base (298)..(298): a, c, t, g, unknown or other
  misc_feature (298)..(298): n is a, c, g, or t
  modified_base (479)..(479): a, c, t, g, unknown or other
  misc_feature (479)..(479): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttataactatgtctctgtaccaacacaccagacaacgccccaaatcataatttangagtacactaagcgccctcgacgggtccctgactcgcttcctctcgtcctaccaaggccttcggccaaaccgaccggccctccccgtgacccgtcgttcgtcgggctcccgagtcgtggaggatggaggctagattattaagttgactagtctacattaactcgcgaggtactaaagttanaaagttgtagtaattacggttccgggacgggtaaacggggtaaacctaaaacgtaccggtaacccgttaccgtaacgggttaccaacggtacccgaacgggtccctacggtacccccctttcgg

SEQ ID NO: 323823 - DNA, 525 bp, Homo sapiens
  misc_feature: GZ8MTXP02HHKR6.4.39.D06.1.454.CMB.2.raw
  modified_base (230)..(230): a, c, t, g, unknown or other
  misc_feature (230)..(230): n is a, c, g, or t
  modified_base (302)..(302): a, c, t, g, unknown or other
  misc_feature (302)..(302): n is a, c, g, or t
  modified_base (516)..(516): a, c, t, g, unknown or other
  misc_feature (516)..(516): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccaggtctcctggacagtcagtcaccatctcctgcactggaaccngcagtgacgttggtcgttataactatgtctctgtaccaacaacaccagacaaacgccccaaatcataattangagtcaactaagccgcctcgacgggtccctgactcgccttctctcgcctcaaggctggacaacaccggccctcccgtgaccgtctcgtggcctcgaggctgaggatggagctagatttatattgctagctacatatgcaggctaagttacaagtgagtattagtcgggacggaacggaccaaaacgtcgaccgtcgtaagcacgaccaggtccnccgtccccg

SEQ ID NO: 323824 - DNA, 551 bp, Homo sapiens
  misc_feature: GZ8MTXP02JA4YX.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacaacacccagcaaacgcccccaaattcataatttatgaggtcacgtaagccggccctcgacggggtccctgattgcttcctctcgcctcaggctggcaacacggcctcctgaccgtctctcggctccagctgagatgagctgattattatgcagctacatatgcaggcagttacaagtgtatattagttacggaacgggtaacggaacctaaacgttacggaacccgttacgtaacgggtacaacggtacccgaaagggccctttaccggcccccgtttaccgg

SEQ ID NO: 323825 - DNA, 651 bp, Homo sapiens
  misc_feature: GZ8MTXP02IPA2M.4.39.D06.1.454.CMB.2.raw
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (422)..(422): a, c, t, g, unknown or other
  misc_feature (422)..(422): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctcctgcactggaaccagcagtgtacgttggtcgttataactatgtctctggtaccaacaactaccagacaaacnccccaaattcataatttangagtcataagccgccctgagggtccctgactcgtcttcctctcgccctacaaggtctcggccaacaccggccctcccgtcgaccgttcctcgtcggggcctccgtaggctgggaagngtcggtaaggcttagtaatttatttaagttcgacgtaacgtcttactaattaacgtcgaccgtaaggtccgttaaaggttaactaaagttgtaggtaacgttaacggtttccggggaacgggtaaacgggtaaccctaaaaaccgttcgggtaaccccgttaccggttaaggtacccgtaaccggtaccccggaaacggtcccgttacccggtaccccccgtttccggg

SEQ ID NO: 323826 - DNA, 594 bp, Homo sapiens
  misc_feature: GZ8MTXP02GERCH.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggacaaacgaccccaaatcaataattatgagtacactaagccgccctcgacggggtccctgactcgtcttcctctcgcctaccgaaggcctggccaaccgaccggccctcccgtcgaccgtctcgtcgggctccgagctgagtatggagctgtattattagttgcagtctactatatcgacgtaggctaagttaactaagtgtagtagttacgttcggggacggtaaacggggaaaccctaaacgtccggtaacccgttaccgtaacgggtaccaacggaccccgtaaggtcccgtacccggtcccccgttaccgg

SEQ ID NO: 323827 - DNA, 597 bp, Homo sapiens
  misc_feature: GZ8MTXP02GUS0U.4.39.D06.1.454.CMB.2.raw
  modified_base (301)..(301): a, c, t, g, unknown or other
  misc_feature (301)..(301): n is a, c, g, or t
  modified_base (324)..(324): a, c, t, g, unknown or other
  misc_feature (324)..(324): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctgtaccaacaacaccagacaaacgccccaaatcataattangagtcatagcgcctcgaggtccngatcgtcttcctctcgcctccaagctaggcaacgacggcctccctgacctctcgtcgggcctaccgaggctaggacgtagtggaggtctagtatttagtttagttacgactaagcttacatttagcgacgagggtactaaacgttactaaagttgtagtaagttacggtttaccgggacgggaaacgggtaaaccctaaaacgtcggtaacccgttacgtaacgttcgaaaccggtacccgaaacggccttaccccggccccgtttacccggg

SEQ ID NO: 323828 - DNA, 562 bp, Homo sapiens
  misc_feature: GZ8MTXP02HAEA3.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctctgtaccaacaacaccagcaaagccccaaatcataattatgagtcactaagcggccctcgacgggtcccctgactcgtcttccctctcgtccctccgaaggcctggccaaaccgaccggtccctccccgtcgacccgtctcgtcgggcctcccgaggctgacggatggaggctgtattattagttgcagtctcatatgacgaggtcaagtttacaaagttgtagtagtaggttcgggacggtaacgggaaccaaacgtcgaccgtactaaggtcacgacccgaaggcctccgacccccgttgg

SEQ ID NO: 323829 - DNA, 592 bp, Homo sapiens
  misc_feature: GZ8MTXP02G109P.4.39.D06.1.454.CMB.2.raw
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (412)..(412): a, c, t, g, unknown or other
  misc_feature (412)..(412): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttgtcgttaataactatgtctctggtaccaacacaccagacaaacnccccaaatcataattangagtcataagcgccctagacgggtccctgatccgtcttcctctcgcctaccgaaggtctggccaaacgacggccctccctcgacccgtctcgtggcctccgaggctgacgntggacgctagattattatgacagtctactagtagtcgacgtagggcctaagttaacaaagttggtaagtacgttaggttaccggggacggtaaacggggaaaccctaaaacggtccgtacccgtaccgtaagggtacccaacggacccgaacgggtccttacccccgccccgtttaccgg

SEQ ID NO: 323830 - DNA, 562 bp, Homo sapiens
  misc_feature: GZ8MTXP02IF6E5.4.39.D06.1.454.CMB.2.raw
  modified_base (302)..(302): a, c, t, g, unknown or other
  misc_feature (302)..(302): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctcctgcactggaaccagcagtgtacgttggtacttataactatgtctctgtaaccaacaacaccagacaaacgccccaaatcaataatttangagtacactaagccgccctcgacggggtcctgactcgtcttccctctcgcctcgaagctggcaacacgccctccctgaccgtctcgtcgggctccgagctagagagtgaggctagtatttattattgactagtctacattagtcgacgaggtactaagtttacaagttgtagtagttagttcgggacggtaaacggaacctaaacgtcgtaacccgtacgtaacggtcaacgacccgaaggtcctccggtccccgtacgg

SEQ ID NO: 323831 - DNA, 515 bp, Homo sapiens
  misc_feature: GZ8MTXP02H9POH.4.39.D06.1.454.CMB.2.raw
  modified_base (300)..(300): a, c, t, g, unknown or other
  misc_feature (300)..(300): n is a, c, g, or t
  modified_base (437)..(437): a, c, t, g, unknown or other
  misc_feature (437)..(437): n is a, c, g, or t
  modified_base (448)..(448): a, c, t, g, unknown or other
  misc_feature (448)..(448): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctctggtacaacacacccaggcaaagcccccaaatcatatttangagtcactaagcggccctcaggggtcccctgatcgcttcctctgcctccaaggctggcaaccacggccctccctgaccgtctctcggggctcccaggctgagatgagctgattattattgctagctcatatgcaggnagttacaatgngaatagtcggcgggtaggaccaaaacgtcgaccgtcaaggtccagccccaaggctcgcccccttacg

SEQ ID NO: 323832 - DNA, 600 bp, Homo sapiens
  misc_feature: GZ8MTXP02GC3LL.4.39.D06.1.454.CMB.2.raw
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
  modified_base (321)..(321): a, c, t, g, unknown or other
  misc_feature (321)..(321): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactatgtctctgtaccaacacaccagacaacnccccaatcatattangagtcactagcgccctgacgggtccngactcgtcttcctctcgcctccgaaggcctacgggcctaaccgaccggtcccttcccgtcgaccgttctcgtcgggcctccgaggcgtgacggtatggagtctgtattattattgactagtctacattgcgagaggactaagttacaagtgtagtagttacggttacggggacgggtaaacgggaaaccctaaacggtaccggtaacccgtttaccggaacgggttaccgaaaccggacccccgtaaacggtcccgtaccccggtcccccgtttaccgg

SEQ ID NO: 323833 - DNA, 576 bp, Homo sapiens
  misc_feature: GZ8MTXP02GNQUY.4.39.D06.1.454.CMB.2.raw
  modified_base (299)..(299): a, c, t, g, unknown or other
  misc_feature (299)..(299): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttataactatgtctcctgtaccaacaacaccagacaaacgccccaaatcatattangagtcatagcgccctcgacgggtccctgactcgtcttcctctcgccctcaaggcctgggccaaccgaccggccctcccgtcgtacccgtctcgtcgggcctcccgagcgtgaggatcggagctagtatttattattcgcagtctacaattgtcgacgacgtcttaagttactaagtgtagagttacgttcggggacgggaacggaacctaaaacgtcgtaaccccgttcgtaacggtcctaaccgacccgtaaggcccgtcccgtacccccgttcgg

SEQ ID NO: 323834 - DNA, 610 bp, Homo sapiens
  misc_feature: GZ8MTXP02JA717.4.39.D06.1.454.CMB.2.raw
  modified_base (299)..(299): a, c, t, g, unknown or other
  misc_feature (299)..(299): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacaacaccagacaaacgccccaatcatattangagtcataagcgccctcgacgggtccctgatcgtcttccctctcgtcctaccgaaggccttggccaaaccgaccggcccctcccgtgacccgttctccgtcggggcctcccgaggcctaggacgatcggaaggtctagtatttattagttgtcacgtcttacaagttagtcgacgtaggtacctaaggttaactaaagtgtagttaacgttaggttccggggacgggtaaaggggtaaccctaaacgttcggaacccgttacgtaacgggtcaaccggaccccgaaggtccctaccgtcccccgttaccgg

SEQ ID NO: 323835 - DNA, 565 bp, Homo sapiens
  misc_feature: GZ8MTXP02JOLE1.4.39.D06.1.454.CMB.2.raw
  modified_base (440)..(440): a, c, t, g, unknown or other
  misc_feature (440)..(440): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacaacacccagcaaacgccccaaatcataatttatgagtcactaagcggccctcgaggggtccctgatcgcttcctctcgcctcaaggctggcaaacacggccctaccctgacccgtctcgtgggcctcccgaggctgagatggaggctgattattattgcagctacattagngacgaggtactaagttacaagtgtagtacgttacggttcgggacgggtaacggaaacctaaacgtcgtaacccgtacgtaacggtaccgaaccggacccgaaggtccctacccggtaccccgtcg

SEQ ID NO: 323836 - DNA, 638 bp, Homo sapiens
  misc_feature: GZ8MTXP02J1HSA.4.39.D06.1.454.CMB.2.raw
  modified_base (313)..(313): a, c, t, g, unknown or other
  misc_feature (313)..(313): n is a, c, g, or t
  modified_base (438)..(438): a, c, t, g, unknown or other
  misc_feature (438)..(438): n is a, c, g, or t
  modified_base (449)..(449): a, c, t, g, unknown or other
  misc_feature (449)..(449): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacgagggtcctgggcccagtctcgccctgactcacgccctccctccgcgtccgggtctcctggacagtcagtccaccatcctcctgcacgtggaaccagcagtgtacgttggtacgttataactatcgtctctacgtaaccaaacaaccaccagacaaacgccccaatcatattangagtacacgtagccgcctgacgggtcctgatcgtcttcctctcgcctacgaggctacggccaaacgccggccctcccgtcgtacccgttcgtccgtcgggtccctaccggacggcgtaggtacgngttaggacgtntagttattacttagtgacgacgtctatatagtcgacgtaacggtacttaagttaacaagttacgtagtaacgttacggtacccggggacggtaaaccggtaacccgtaaacgtaccggtaaccccgtaacggtaacggtaccgaccggtaccccggaacggtccccgtacccggtcccccgtttaccgg

SEQ ID NO: 323837 - DNA, 602 bp, Homo sapiens
  misc_feature: GZ8MTXP02HL33G.4.39.D06.1.454.CMB.2.raw
  modified_base (229)..(229): a, c, t, g, unknown or other
  misc_feature (229)..(229): n is a, c, g, or t
  modified_base (303)..(303): a, c, t, g, unknown or other
  misc_feature (303)..(303): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctcctgcactggaaaccngcagtgtacgttgtacttaataactatgtctctcgtaccaacaacaccagacaaacacccaaatcaataattangacgtacactaacgcgccctacgacgggtcctagactcgtcttcctctcgcctacgaggtctacgccaacgccgcctcccgtcgaccgtcgtcgtcggcctccgaggtcgtaggagtagtaggacgtctagttatttaagtttattcgactacgtctatagtacgtcgacgacgtacgtaacgttaacaagtgtaagtagttacggttacgggacggaaacggtaaaccgtaaacgtaccgtaaccggtaccgtaacggtacgaaccgacccgaacgtccgtacccgtaccccgtacgg

SEQ ID NO: 323838 - DNA, 579 bp, Homo sapiens
  misc_feature: GZ8MTXP02JL340.4.39.D06.1.454.CMB.2.raw
  modified_base (424)..(424): a, c, t, g, unknown or other
  misc_feature (424)..(424): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctgtaccaacacaccaggacaaacgccccaaattcataatttatgagtcactaagccgccctcgaggggtccctgactcgtcttcctctcgccctaccgaagctcggcaaaccgacggccctcccctgacccgtcctcgtcggggccttcccgaggctgaacgggntcggaaggtctaggtatttattattcgactagtctacatatgcacgggctaagtacaagtgtagtacttagttcgggacgggagggaacctaaacgtcggtacccgtaccgtaagggactacggacccgaaggccttcccggaccccctttacgg

SEQ ID NO: 323839 - DNA, 536 bp, Homo sapiens
  misc_feature: GZ8MTXP02JVM3V.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgcccccaaattcataatttatgaggtcactaagcgccctcaggggtccctgatcgcttcctctgcctccaaggctggcaacacggccctccctgaccgtctctcggggccttcccgaggcctggaggatcgaggctgatttattattgcagtctcagtatgcaggcaaggttacaagtgtagatagttcggacggagggaccaaaacgtcgaacccgtctaaggtcacgaccaacggctacgccccctcgg

SEQ ID NO: 323840 - DNA, 596 bp, Homo sapiens
  misc_feature: GZ8MTXP02GAGPP.4.39.D06.1.454.CMB.2.raw
  modified_base (310)..(310): a, c, t, g, unknown or other
  misc_feature (310)..(310): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcacatctcctgcactggaaccagcagtgacgttggtcgttaataactatgtctcctaggtaccaaacaaccaccaggaccaaacgaccccaaattcaataattangagtcactaagcgccctcgacgggtccctgactcgtcttcctctcgcctccgaggctggccaaccgacggccctaccctcgaccgtctcgtcgggctcccgaggctggagtatcggaggtcttagatttattattgactaggtcttacaattagcgactacggtctaaaggttacaaagttgtaagtaagttacggttacgggacgggtaaacggaacctaaaacgtcggacccgttaccgttaaggaccaacgacccgtaaggtccctaccgtacccccgttcgg

SEQ ID NO: 323841 - DNA, 532 bp, Homo sapiens
  misc_feature: GZ8MTXP02FMEYC.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctgtaccaacaacacccagcaaagccccaaattcataatttatgagtcactaagcggccctcaggggtccctgatcgcttcctctgcctcaaggctggcaacacggcctccctgaccgtctctgggctccgaggctgagatgagctgattattatgcagctcatatgcaggcaagttacaatgtagtatagttcggacgggaagggtaccaaaacgtcgaaccgttaccgtaaggtccaacggacccgaagggtcctccgacccccgttcgg

SEQ ID NO: 323842 - DNA, 561 bp, Homo sapiens
  misc_feature: GZ8MTXP02FNDA5.4.39.D06.1.454.CMB.2.raw
  modified_base (306)..(306): a, c, t, g, unknown or other
  misc_feature (306)..(306): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaactacccagacaaacgcccccaaatcataatttangagtcactaagccgccctcgacgggtccctgatcgtcttcctctgcctccaaggctggcaacacggcctccctgacccgtctcgtcgggctccgaggctggaggatggagctgtattattattgctagctactatatgacgaggctaagttacaattgtacgtattagttcgggacggaacgggaacctaaaacgtccgaaccgttccgtaagggttaccaacggacccgaaaggccgtaccgcccccgtttacg

SEQ ID NO: 323843 - DNA, 557 bp, Homo sapiens
  misc_feature: GZ8MTXP02JUS9F.4.39.D06.1.454.CMB.2.raw
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctctgtaccaacacaccagacaaacgccccaaattcataatttangagtcactaagcgccctcgacgggtccctgatcgcttccctctcgcctcaggctggccaacncggccctccngaccgtctcgtgggcctccgaggctggagatggagtctgtattattatgcagtctctatatcgacgacggctaacgttacaattggtagtagttacgtcggggacggaacggtaacctaaacgtccggtaacccgtacggtaacggtaccgacgacccgtaaggcccgtcccgaccccgttcgg

SEQ ID NO: 323844 - DNA, 553 bp, Homo sapiens
  misc_feature: GZ8MTXP02IYO54.4.39.D06.1.454.CMB.2.raw
  modified_base (298)..(298): a, c, t, g, unknown or other
  misc_feature (298)..(298): n is a, c, g, or t
  modified_base (439)..(439): a, c, t, g, unknown or other
  misc_feature (439)..(439): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctcctgcactggaaccagcagtgacgttggtcgttataactatgtctctgtaccaacacaccagacaagccccaaatcataatttangagtcactaagcggccctcgacgggtccctgactcgtcttcctctcgcctaccgaagctagcaacgaccggccctcccgtgacccgtctcgtcgggctccgagctgagatgaggctgattattatgcagtctcatatgacnggactaagttacaagtgtagtagttagttcgggacggtaacgggaacctaaacgtcggtacccgttacgtaaggtacccacgacccgaagggtccctccggtacccccgttcgg

SEQ ID NO: 323845 - DNA, 596 bp, Homo sapiens
  misc_feature: GZ8MTXP02IVW77.4.39.D06.1.454.CMB.2.raw
  modified_base (337)..(337): a, c, t, g, unknown or other
  misc_feature (337)..(337): n is a, c, g, or t
  modified_base (367)..(367): a, c, t, g, unknown or other
  misc_feature (367)..(367): n is a, c, g, or t
  modified_base (401)..(401): a, c, t, g, unknown or other
  misc_feature (401)..(401): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagcaaacgccccaaatcataatttatgaggtacactaagccggaccctcgagggtccccngactcgctcctctgcctccagctggcaacncgcctcctgaccgtctctggctccgagctagagntgagtctagtatttactagttgctacgtcactagttatcgaccgaggactaaggtttaacagttagtagttaagttacggttacgggtacgggaaccgggtaaacctaaaacggttccggaaccccggttacgttaacgggtaaccgtacgaccccggaaacggtccccggttaccgacccccggtttccccggg

SEQ ID NO: 323846 - DNA, 693 bp, Homo sapiens
  misc_feature: GZ8MTXP02FZA63.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtcaccatctcctgcactggaaccagcagtgacgttggtcgttataactatgtctctggtaccaacaactaccagacaaacgaccccaaattcaataatttatagagtacactaagccggccctcgacggggtccctgactcgtcttcctctcgcctacaaggctggcaacgaccggccctcccgtcgtacccgtcgtccgtcgggcctcccgagggtctaggacggtagtgggaaggtcgttaggtaaattttagttttaaacgtttcggactaacggtccttactaaagtttacgtacgaccggtaagggtaccttaaaaggtttaccaaagtttcggtaagtaaacgtttaacgggtttaccgggggaacgggtaaaccgggtaaacccgtaaaacggttaccggtaaccccggtttaccgtaacgggttacccgaaaccggtaccccgaaacggggtccccttaccccggtccccccgtttaacggg

SEQ ID NO: 323847 - DNA, 552 bp, Homo sapiens
  misc_feature: GZ8MTXP02HYCH0.4.39.D06.1.454.CMB.2.raw
  modified_base (304)..(304): a, c, t, g, unknown or other
  misc_feature (304)..(304): n is a, c, g, or t
  modified_base (331)..(331): a, c, t, g, unknown or other
  misc_feature (331)..(331): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggaaccagcagtgacgttggtcttataactatgtctcctggtaccaaacaacacccagcaaacgccccaaatcatatttangagtcataagcgccctcgagggtcccngatcgctttcctctcgcctacgaggctcggcaaccgacggccctccctgacccgtctcgtcgggcctccgaggctggacgatggagtctagtattattagttgactagtcttacatatgcgaggctaagttacaaagtgtagtataggttcgggacggaacggaaaccaaacgtcgacccgttcgtaaggtcacgacccgaaggccctcgtcccccgtcgg

SEQ ID NO: 323848 - DNA, 636 bp, Homo sapiens
  misc_feature: GZ8MTXP02HLUGM.4.39.D06.1.454.CMB.2.raw
  modified_base (226)..(226): a, c, t, g, unknown or other
  misc_feature (226)..(226): n is a, c, g, or t
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
  modified_base (420)..(420): a, c, t, g, unknown or other
  misc_feature (420)..(420): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggaaccngcagtgacgttggtacttaataactatgtctctgtaaccaaacaacaccagacaaacgaccccaaatcataattangagcatacgcgccctcgacgggtccngactcgtcttccctctcgcctcgaagctacggccaaccgaccggtcccctcccgtcgtacccgtctccgtcgggcctccgagcgtggagtanggagtctagtactttaattagttgactacgtctataacgttaagtgacccgtaagggtaccttaaggtttaaactaaagttcggtaagttaatttaacgggtttacgggaaccgggaaacggggtaaaccctaaaacggtaccggtaacccggttaccgtaacggtccgaaaccggtaccccgaaagggtcccctacccggtacccccgttcccgg

SEQ ID NO: 323849 - DNA, 540 bp, Homo sapiens
  misc_feature: GZ8MTXP02J173E.4.39.D06.1.454.CMB.2.raw
  modified_base (305)..(305): a, c, t, g, unknown or other
  misc_feature (305)..(305): n is a, c, g, or t
  modified_base (336)..(336): a, c, t, g, unknown or other
  misc_feature (336)..(336): n is a, c, g, or t
  modified_base (411)..(411): a, c, t, g, unknown or other
  misc_feature (411)..(411): n is a, c, g, or t
  modified_base (464)..(464): a, c, t, g, unknown or other
  misc_feature (464)..(464): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctgtaccaacaacacccagacaaacgccccaaattcataatttangagtcactaagccggccctcgacgggtcccngatcgcttcctctgccctcaaggctggcaacaccggcctcctcgaccgtctcgtcgggcctccgaggctggacgngtgaggctagtattattattgcagctcattatgcaggacagttacaagtgtanatagttcggacggaacgggaaccaaacgtcgacccgtacgtcggacacggacccaaggcctaccggtccccctcgg

SEQ ID NO: 323850 - DNA, 558 bp, Homo sapiens
  misc_feature: GZ8MTXP02HOTGZ.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctcctggtaccaacaacacccagcaaacgccccaaattcataattatgagtcactaagcgccctcgaggggtccctgatcgcttccctctcgcctcaaggctggccaaacacggccctccctgacccgtctcgtcggcctccgagctggagatgaggctgtattattattgcagtctacatatgcgaggctagttacaagtgtagtaagttagttacgggacgggtaaacgggtaacctaaacgtcgtaacccgttacgtaacggtacgacgacccgaaaggcctaccgtcccccgttccgg

SEQ ID NO: 323851 - DNA, 654 bp, Homo sapiens
  misc_feature: GZ8MTXP02FM1CF.4.39.D06.1.454.CMB.2.raw
  modified_base (299)..(299): a, c, t, g, unknown or other
  misc_feature (299)..(299): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtcccgggtctcctggacagtcagtcaccatctcctgcactggaaccagcagtgacgttggtcgttataactatgtctctgtaccaacacaccagacaaacgccccaaatcatattangagtcactagccgccctcgacgggtcctgatcgtcttcctctcgacctccgaagctacgggccaaccgacggtccctcccgtcgacccgtcgtccgtcgggtcctccgaggtctaggaggtactggaaggtctagtaatttatttaagttcgacgtaagtcctataagttagtcgacgtaacgggtacttaaaggtttaactaaagttggttaacgttaagtttacgggtttacggggaaccgggggtaaacggtaaacccgttaaaacgtccgggtaacccgttaccggtaacgggttaccgaacccgggaccccgtaaacggtccccgtacccccgggtacccccgttcccgg

SEQ ID NO: 323852 - DNA, 581 bp, Homo sapiens
  misc_feature: GZ8MTXP02I4NTI.4.39.D06.1.454.CMB.2.raw
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (345)..(345): a, c, t, g, unknown or other
  misc_feature (345)..(345): n is a, c, g, or t
  modified_base (358)..(358): a, c, t, g, unknown or other
  misc_feature (358)..(358): n is a, c, g, or t
tcagagcactgtagcacgaccggtgctcgatttagtgacatctcgcagttctttgggttttgggggaagtgtggtacggcctggggggtccctgagactctcctgtacagcctctggattctcctttgatgattatggcatgagctgggtccgccaagctccgagggaaggggctggagtgggtgtctggtatgaattggagtggcggtagtacagcttatgcagactctgtgaaggccatcaccatcnccaganacaacgcaagactcctgtatctgcaattgaacngtcngagagccgaggacacggtccttgtattacgtgtgcgaagaactagtttagggntagtagtgtaacngctgcttagtcgtcgacgttggggtttacgtacgtacggtcggggaccgaggggacgtcccgtggtccaccgtctacctcacgtccctcccaccgacggcccacgtcccggttcctcccccgtggcccgtcccgtcgccgtaccgacggccgaccaccgtccgacgacgacacgacgccggcccgtcggccgtcgcgtacggtaccgaacggtaccttacccg

SEQ ID NO: 323853 - DNA, 574 bp, Homo sapiens
  misc_feature: GZ8MTXP02IP3JH.4.39.D06.1.454.CMB.2.raw
  modified_base (212)..(212): a, c, t, g, unknown or other
  misc_feature (212)..(212): n is a, c, g, or t
  modified_base (301)..(301): a, c, t, g, unknown or other
  misc_feature (301)..(301): n is a, c, g, or t
  modified_base (461)..(461): a, c, t, g, unknown or other
  misc_feature (461)..(461): n is a, c, g, or t
tcagagcactgtagcacgaccggtgctcgatttagtgacatctcgcagttcgtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccntcctcctgcactggaaccagcagtgacgttggtcttataactatgtctctgtaccaacacaccagacaaagccccaaatcataatttangagtcactaagccggccctgacgggtccctgactcgtctttcctctcgtccctacgaacggctcggcaaacgaccggccctaccctgacccgtctcgtcggctcccgaggctcgagtatggaggtctagtattattattgcagtctcatagtgacgaggntaagttaacgaattgtagtaacttaggttacgggacgggtaacgggaacctaaacgtcgtaccggttacgtaaggtacacggtacccgaaggcctcccggtcccccgttacgg

SEQ ID NO: 323854 - DNA, 542 bp, Homo sapiens
  misc_feature: GZ8MTXP02FMFP0.4.39.D06.1.454.CMB.2.raw
  modified_base (305)..(305): a, c, t, g, unknown or other
  misc_feature (305)..(305): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgccccaaattcataatttangagtcactaagcgccctcgaggggtccctgatcgtcttcctctgcctcaaggctggcaacacggcctccctgaccgtctcgtcgggctccgaggctgagatgaggctgattattatgcagctcatatgcgaggctagttacaattgtagtatacgttcgggacgggtaagggaaccaaaacgtcgaacccgttacgtaagggtcaacggcccgaaaggtcctccggcccccgttcgg

SEQ ID NO: 323855 - DNA, 575 bp, Homo sapiens
  misc_feature: GZ8MTXP02HL18O.4.39.D06.1.454.CMB.2.raw
  modified_base (332)..(332): a, c, t, g, unknown or other
  misc_feature (332)..(332): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtacaacaacacccagcaaacgccccaaattcataatttatgagtcactaagcgccctcgaggggttcccngatcgctccctctgcctcagctgcacncgcctccngacgtctcgcggtctccagctgagtangagctgattattattcgntagtctacatatgcaggctaagttacaaagttgtacgtattaggttacgggacgggtaaacggaaaccgaaaacgttcggaacccggtttacccgaacggggttaccaaaccggggtaccccgtaaaacgggccccgttaccgggtacccccccctttacggg

SEQ ID NO: 323856 - DNA, 584 bp, Homo sapiens
  misc_feature: GZ8MTXP02HC93O.4.39.D06.1.454.CMB.2.raw
  modified_base (301)..(301): a, c, t, g, unknown or other
  misc_feature (301)..(301): n is a, c, g, or t
  modified_base (339)..(339): a, c, t, g, unknown or other
  misc_feature (339)..(339): n is a, c, g, or t
  modified_base (449)..(449): a, c, t, g, unknown or other
  misc_feature (449)..(449): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagctagttacgttggtacgttataactatgtctctgtacaacaacaccagacaacgccccaatcataattangagtacactagcgcctcgacgggtcctgactcgcttcncctcgcctcgaggctcggacacgccggtcctccgtcgtacctctcgtcgggcctcgacggtctggacgagtaggagtcgttagtaatttagttagttcggactagcttanattagtcgaccgaggtactaaagttacaagttggtataagtttcgtacggggacggtaaacggaaacctaaacggttcgaacccgttacgtagggcaaccggaccgtaacggtcctacccgccccgttaggtccc

SEQ ID NO: 323857 - DNA, 544 bp, Homo sapiens
  misc_feature: GZ8MTXP02I29QB.4.39.D06.1.454.CMB.2.raw
  modified_base (401)..(401): a, c, t, g, unknown or other
  misc_feature (401)..(401): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctctgtaccaacaacaccagcaacgccccaatcataatttatgagtcactaagcggccctcgagggtccctgatcgcttcctctgcctccaagctggcaacgaccggcctccctcgaccgtctcgtgggctcccgagctgaggntggagtctgattattagttgctagtctctatatgcgaggctaagttacaagtgtagattagttacggggacggtaagggacctaaacgtcgacccgttacgtaaggtaccacggacccgaaggtccgtacgcccccgttacgg

SEQ ID NO: 323858 - DNA, 563 bp, Homo sapiens
  misc_feature: GZ8MTXP02G79SG.4.39.D06.1.454.CMB.2.raw
  modified_base (299)..(299): a, c, t, g, unknown or other
  misc_feature (299)..(299): n is a, c, g, or t
  modified_base (465)..(465): a, c, t, g, unknown or other
  misc_feature (465)..(465): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctctggtacaacaacaccagcaaacgccccaaatcataattangagtcataagcgccctgacgggtccctgactcgtcttcctctcgcctcgaaggctagcaaaccgcggtcccctcccgtcgacccgtctccgtcggctacccgaggctggaacggatggagtctgtattatattgacctagctacatagtcgcgtaggctaagttanaagttgtagtaaatcgttacggacgggaaagggacctaaaacgcgtaacccgttacgtaacggacaccgaccgtaaggcctacccgtccccgttccgg

SEQ ID NO: 323859 - DNA, 567 bp, Homo sapiens
  misc_feature: GZ8MTXP02F41TQ.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacaacacccaggcaaacgcccccaaattcataatttatgaggtcaactaagcggccctcgaggggtcccctgactcgcttcctctcgcctccaaggctggcaacacggcctccctgaccgtctctcgggctcccgaggctgagatggagctgatttattattgctagctacattatgacaggctaagttacaagttgtagtattacgttcgggacgggtaaacgggaacctaaaacgtcggaacccgttaccgtaaggtaccgaacggaccccgaaggtcctaccggcccccgttaccgg

SEQ ID NO: 323860 - DNA, 605 bp, Homo sapiens
  misc_feature: GZ8MTXP02JKN8T.4.39.D06.1.454.CMB.2.raw
  modified_base (300)..(300): a, c, t, g, unknown or other
  misc_feature (300)..(300): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgtaccaacaacaccaggacaaacgccccaaatcataattangagtcactaagccgccctcgacgggtccctgatcgtcttcctctgcctacaggctcggcaaccgacggccctcccgtcgacccgttctccgtcggggcctacccgaggtcctggagaacgttggagggtcctaggtatttaacgttattgaccgacgtctactaattacgcgtcgaagggtctaaacggtttaacaaagttgagtaagttacgttacggggcggaaaggggaaacctaaacgtcggtaacccgtacgtaaggtaccaacggtaccccgtaaggcccgtaccggacccccgttcgg

SEQ ID NO: 323861 - DNA, 536 bp, Homo sapiens
  misc_feature: GZ8MTXP02FPVOR.4.39.D06.1.454.CMB.2.raw
tcagagcactgtagcacgaccggtgctcgatttagtgacatctcgcagttctttggggggttctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgcccccaaattcataatttatgaggtcactaagcggccctcaggggtccctgatcgcttcctctgcctcaggctggcaacacggcctccctgaccgtctctggggcctcccgaggctgaggatggaaggctgattacgttattgcagctcatatgcaggtctagttaacaatgtagatagttcgggcggaaggggtacccaaaacgtcgaccgttcctaagggtcaacgcccaaggctccgcccccgtcgg

SEQ ID NO: 323862 - DNA, 559 bp, Homo sapiens
  misc_feature: GZ8MTXP02F3LPT.4.39.D06.1.454.CMB.2.raw
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatcctcctgcactggaaccagcagtgacgttggtcttataactatgtctctgtaccaacaacaccagacaaacgccccaaatcaataattangagtcactaagcgccctgacgggtccctgatcgcttctctcgcctcagctgcaacncggcctcccngaccgtctcgtggcctccgagctggagatgagctagtattattaagttgactacgtctactaatagtcgacgaaggtctaaaggttacaatgtagtaattacgttcgggacgggaaacgggtaaacctaaaacgtcgtaacccgttacgtaaggtccgaacgacccgaaaggtcctacccggcccccgttcgg

SEQ ID NO: 323863 - DNA, 594 bp, Homo sapiens
  misc_feature: GZ8MTXP02GTSOZ.4.39.D06.1.454.CMB.2.raw
  modified_base (298)..(298): a, c, t, g, unknown or other
  misc_feature (298)..(298): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgtaccaacacaccagcaaacgccccaaatcataatttangagtcataagcgccctgacgggtccctgatcgtctcctctcgacctacgagcctggccaaacgaccggtccctcccgtcgacccgttctcggtcgggcctcccgaggcctaggaaggtagtggagtctagtaactttagtttaagttcgactagtcttactaagttagcggacacggtactaagttactagtagtagtaacgttacggtacgggacggtaacggaacctaacgtcgtacccggtacgtaacggtaccgaaccgtacccgaacggtcccgtaccccggacccgtcgg

SEQ ID NO: 323864 - DNA, 586 bp, Homo sapiens
  misc_feature: GZ8MTXP02JKMKT.4.39.D06.1.454.CMB.2.raw
  modified_base (229)..(229): a, c, t, g, unknown or other
  misc_feature (229)..(229): n is a, c, g, or t
  modified_base (300)..(300): a, c, t, g, unknown or other
  misc_feature (300)..(300): n is a, c, g, or t
  modified_base (434)..(434): a, c, t, g, unknown or other
  misc_feature (434)..(434): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggaaagtcagtcaccatctcctgcactggaaccngcagtgacgttggtcttataactatgtctctgtaccaacaacaccagacaaacgccccaaatcataattanagagtcactaagcggcctcgacggggtcctgactcgtcttctcctcgcctcgagctggacacgacgcctcctgaccgtcacgtcgggcctcgaggctggacgagtgagctgtattattagttgactagtcctanatagtgacgtaggactaagtttacaaagttggtagtacgttaaggttccgggacgggtaaacggggaaaccctaaaacggtcgtaaccccgttaccgtacggccaaccggaccccgtaacggacccgtcccggtacccccgtcggtaccccg

SEQ ID NO: 323865 - DNA, 584 bp, Homo sapiens
  misc_feature: GZ8MTXP02GPSMA.4.39.D06.1.454.CMB.2.raw
  modified_base (310)..(310): a, c, t, g, unknown or other
  misc_feature (310)..(310): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (473)..(473): a, c, t, g, unknown or other
  misc_feature (473)..(473): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcacgcctccctccgcgtccgggtctcctggacagtcagtcaccatctcctgcactggaaccagcagtgacgttggtcgttaataactatgtctcctgtaaccaaacaaccaccaagacaaacgccccaaattcaataatttanagagtcaactaacgccggaccctcgacggggtccctagatcgtcttcctctcgcctacaaggctggcaacacgcctcccngaccgtctcgnggcctccgaggctaggaggatggaagctagattattatgctagtcctataatatacgcgaggactaagttanaaagttgtagtagttacgttcgggacggtaacgggaaaccctaaacgtcggtaaccccgttacgaacggtccaacggacccgaacgtccgtacccggcccccgtttaccgg

SEQ ID NO: 323866 - DNA, 521 bp, Homo sapiens
  misc_feature: GZ8MTXP02JT764.4.39.D06.1.454.CMB.2.raw
  modified_base (298)..(298): a, c, t, g, unknown or other
  misc_feature (298)..(298): n is a, c, g, or t
  modified_base (364)..(364): a, c, t, g, unknown or other
  misc_feature (364)..(364): n is a, c, g, or t
  modified_base (419)..(419): a, c, t, g, unknown or other
  misc_feature (419)..(419): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtccagtcaccatctcctgcactggaaccagcagtgacgttggtcgttataactatgtctctgtacaacacacccagcaaagccccaatcatattatnagtcactaagcgaccctcagggtccctgatcgcttcctctgctcaagctggcaacacggcctcccngacccgtctctcggcttccgagctgacggatgaggctgattagttatgcagtctnatatgacaggcaaggttacaaagtgtagtatagttcgggacggagggaaccaaaacgtgaacccgtcgtaacggcacgcccgtaaggcctcgcccccgtcgg

SEQ ID NO: 323867 - DNA, 559 bp, Homo sapiens
  misc_feature: GZ8MTXP02IW1NN.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccaccatctcctgcactggaaccagcagtgacgttggtcttataactatgtctctgtacaacacaccagcaaagccccaaatcataattatgagtcactaagcgccctcgacgggtccctgactcgtcttcctctgcctcgaaggctggcaacaccgcctccctgaccgtctcgcgggctccaggctggagtagtcgaggtctgattattatgacagctcatatgacaggtctaaagtttacaaagttgtagtaattagttacgggacggtaaagggaaccctaaacgtacggtaacccgtacgtaagggtccaacggaccccgaagggtcccttaccggccccctttaccgg

SEQ ID NO: 323868 - DNA, 682 bp, Homo sapiens
  misc_feature: GZ8MTXP02I58CG.4.39.D06.1.454.CMB.2.raw
  modified_base (306)..(306): a, c, t, g, unknown or other
  misc_feature (306)..(306): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggacaaacgccccaaattcataatttangagtcactaagccggccctcgacgggtccctgatcgtcttcctctcgcctcgaacggcgttcggccaaccgaccggcccctcccgtacgacccgttctccgtcggggtccctacccgtacgggccgttaggaagggtacgttacggggaaggtcccgtttagggttaatttaagttttaacgtttcgggacctaaagggtccctttaccgaaagtttaacgttcgaaccgtagggtacccgtaaagtttaaccgaaagtttggttaagaagtttacggttacgggggacggtaaacggggaaacctaaccgtacggtacccgttacggtaacggtacgaacggacccgaacgccgtacccggtcccccgttaccgg

SEQ ID NO: 323869 - DNA, 624 bp, Homo sapiens
  misc_feature: GZ8MTXP02JOE1F.4.39.D06.1.454.CMB.2.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (265)..(265): a, c, t, g, unknown or other
  misc_feature (265)..(265): n is a, c, g, or t
  modified_base (297)..(297): a, c, t, g, unknown or other
  misc_feature (297)..(297): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctcctgcactggaaccngcagtgacgttggtcttataactntgtctctgtaccaanaactaccagacaacgccccaaattcatattangagtcataacgccgcctcgagggtccctgactcgtcttccctctcgaccctacgaggtctacggacctaaccgaccggtccctcccgtacgtacccgtctcggtcgggcctacccgaggctaggaaggtatggagtctagtaatttagtttattcgactagtctactaagtagtcgacgaggtaccttaaggttacaagttagtagtaagtttacggtacggggaccggaaagggtaaaccctaaaaccggttcggaaccccgttacgtaacgggtaccaaccggtacccggtaaggtccccgtaacccgggtcccccgtttaccgg

SEQ ID NO: 323870 - DNA, 522 bp, Homo sapiens
  misc_feature: GZ8MTXP02FM6H5.4.39.D06.1.454.CMB.2.raw
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (395)..(395): a, c, t, g, unknown or other
  misc_feature (395)..(395): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacaacaccagacaaacnccccaaatcataattangagtcactaagcgccctcgagggtccctgatcgtcttcctctgcctcaaggctggcaacncgcctcctgacctctcnggctccgagctggagangagctagattattatgacagtctanaagtngacgagactaagtanagtgtagacgttacggtacgggacggaacgaaacctaacgtcgtaccgtacgtaagtacacgaccgacgcctccgcccgtcg

SEQ ID NO: 323871 - DNA, 564 bp, Homo sapiens
  misc_feature: GZ8MTXP02FTCAX.4.39.D06.1.454.CMB.2.raw
  modified_base (451)..(451): a, c, t, g, unknown or other
  misc_feature (451)..(451): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacaacacccagacaaacgccccaaatcataattatgagtcataagcgccctcaggggtccctgatcgcttcctctcgcctcaagctggccaacacggccctacccgtcgtaccgtctcgtcgggctcccaggctgagatgaggctgattattattgacagctacatatagcaggctaaggttaanaagtgtagtacgttacggttcgggaacgggtaaacggaaaccctaaacgtaccgtaaccgttaccgtaacggtaccgaaccgtacccgacggtccgtacccggtaccccgtcg

SEQ ID NO: 323872 - DNA, 558 bp, Homo sapiens
  misc_feature: GZ8MTXP02FNA9R.4.39.D06.1.454.CMB.2.raw
  modified_base (301)..(301): a, c, t, g, unknown or other
  misc_feature (301)..(301): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacaccagacaaacgccccaaatcatattangagtcactaagcgccctcgaggggtccctgatcgtcttcctctcgcctcgaaggctggcaacgacggcctccctcgaccgtctcgtcgggctcccgaggctggagatgaggcttgattattattgcagctcatatgcaggctaagttacaagttgtagtattacggttcgggacgggaacgggtaacctaaacgtacgaacccgttccgtaaggtccgacgtaccccgaaacgggtcctaccggcccccgttaccgg

SEQ ID NO: 323873 - DNA, 664 bp, Homo sapiens
  misc_feature: GZ8MTXP02IN57I.4.39.D06.1.454.CMB.2.raw
  modified_base (284)..(284): a, c, t, g, unknown or other
  misc_feature (284)..(284): n is a, c, g, or t
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtcccgggtctcctggacagtcagtcaccatcctcctgcactggaaccagcagtgacgttggtcttataactatgtctctgtaccaacacaccagacaacnccccaaatcatattanagagtcataagccggccctcgacgggtccctgactcgtcttccctcgtcnccctaccgaacgtctacggccaaccaccggtccctacccgtcgtaccgtctcgtcggcctccgaggtctggagagtggacgtctagtaacttatttattcgactacgtccttataattacgtcgacgtacggtacgttaaagttactaaagttggttaagttaacgtttacgggtttaccggggaaccggggtaaaaccgggtaaacccgtaaaaccggttacccggttaacccggtttaccggtaaccggttaccgaaaccggtaccccggtaaaaccggtcccgtttacccccggtacccccgtttacccgg

SEQ ID NO: 323874 - DNA, 578 bp, Homo sapiens
  misc_feature: GZ8MTXP02FJT3I.4.39.D06.1.454.CMB.2.raw
  modified_base (228)..(228): a, c, t, g, unknown or other
  misc_feature (228)..(228): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcgttataactatgtctcctggtaccaacaacacccagacaaacgaccccaaatcaataattatgagtcactaagcgccctcgacggggtccctgatcgcttcctctcgcctccaagctggcaacacggcctccctgacccgtctcgtcggcctcccgaggctggagtagtgacggctgtaatttattattgactagtcttacaattatacgcaggactaagttaacaagttgtagtattacgtacggggacgggaaacgggtaacccaaaacgtcgaacccgttaccgtaacggtaccgacggacccgaaggtcctcccggtacccccgttaccgg

SEQ ID NO: 323875 - DNA, 628 bp, Homo sapiens
  misc_feature: GZ8MTXP02JV8QY.4.39.D06.1.454.CMB.2.raw
  modified_base (229)..(229): a, c, t, g, unknown or other
  misc_feature (229)..(229): n is a, c, g, or t
  modified_base (300)..(300): a, c, t, g, unknown or other
  misc_feature (300)..(300): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcgttataactatgtctcctgtaccaacacaccagcaaacgccccaaatcataattangagtcactagcgccctcgacgggtcctgactcgtcttcctctcgccctaccgaggctggaccaaccgaccggtcccttacccgtcgacccgttcctcgtcggggtcccttcccgagtccgtaggagggtatgggacgggtcttagtatttattagttcggacacggtcctgtattagtcgaccgtaagggcctaaaggttaactaagttgtagttaaccgttaggttcggggaacgggaacgggaaacctaaaacggtcggtaacccgttaccggtaacggttaccgaccggtaacccgaacgggtccctcccggtaccccccgtcgg

SEQ ID NO: 323876 - DNA, 593 bp, Homo sapiens
  misc_feature: GZ8MTXP02FUGI1.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctgtaccaacaacaccaggacaaacgccccaaatcataattatgagtcactaagcgccctcgacgggtcctgactcgtcttcctctcgcctaccgaaggtcctacgggccaaaccgaccggtcccctaccccgtacgtacccgtcgtccgtcggggccctacccgaggcctaggagtatggacggctagtatttagttagttgacacgtctcaagtatcgcgaggactaagtacaagtgtagtagttagtcgggacgggaaacgggaaacctaacgtacggacccgttacgtaacggtcgaacgtacccgaaggtcctccggcccccgttacgg

SEQ ID NO: 323877 - DNA, 540 bp, Homo sapiens
  misc_feature: GZ8MTXP02FNJ79.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacaacacccaggacaaacgccccaaattcataattatgagtcactaagcgccctcaggggtccctgatcgcttcctctgcctccaagctggcaacacggccctccctgaccgtctctgggctcccgaggctgagatgaggctgattatattgcagctacatatgcaggcagttacaatgtagtatagttcgggacggtacgggaaccaaacgtcggaacccgttccgtaaagggttcaacggaccccaaagggtcctaccggcccccgttcgg

SEQ ID NO: 323878 - DNA, 573 bp, Homo sapiens
  misc_feature: GZ8MTXP02J3X3X.4.39.D06.1.454.CMB.2.raw
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtacgttggtcgttaataactatgtctcctaggtaccaaaccaacacccaggaccaaacgacccccaaattcaattaaatttangaggtacactaacgccgccctcgacgggtccngactcgcttccnctgcctacaaggctggccaacgacccggccctccgtcgacccgtctcgtcgggcctccgaggcctaggagacgtggaaggtctaggtatttattagttgacagtcctatatatgccgtaggactaaggtttacatgagtacgtacgtcggacggaacgtaccaacgtccgaccgtaccgtaagaccacgacccgtagccctccgccccgtcg

SEQ ID NO: 323879 - DNA, 586 bp, Homo sapiens
  misc_feature: GZ8MTXP02IYAHS.4.39.D06.1.454.CMB.2.raw
  modified_base (303)..(303): a, c, t, g, unknown or other
  misc_feature (303)..(303): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgtaccaacaacacccaggacaaacgccccaaattcataatttangagtcactaagcggccctcgacgggtccctgactcgtctcctctcgcctccagctggcacgcggtcctccgtgaccgtctcgtcgggcctccgaggctggagatggagtatgatttattagtgctacgtctacattagtacgacgagggtactaggttaacaagtgtaagtacgttagttacggggacgggtacgggaaaccctaaacggtccgtaacccggttaccgtaagggtacccacggacccggtaacggtcccgtacccggacccccgtttaccggg

SEQ ID NO: 323880 - DNA, 578 bp, Homo sapiens
  misc_feature: GZ8MTXP02JIU63.4.39.D06.1.454.CMB.2.raw
  modified_base (305)..(305): a, c, t, g, unknown or other
  misc_feature (305)..(305): n is a, c, g, or t
  modified_base (437)..(437): a, c, t, g, unknown or other
  misc_feature (437)..(437): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctcctccgcgtccgggtctcctggacagtcagtcaccatctcctgcactggaaccagcagtgacgttggtcgttataactatgtctcctgtaccaaacaacacccaggcaaacgccccaaattcataatttangagtcactaagcgccctcgacgggtccctgatcgtcttcctctcgcctccaaggctggcaacacggcctccgtgaccgtctcgtcgggcctccgaggctcggaggtatcggaggtctagatttattagttgnagtctacagtatgaccaggtactagttacaagtgtagtagtacgttcgggacggtaacgggtaacctaaacgtcggtacccgttacgtaacgggtcaaccgggtacccgaaacgggtcccgttccggacccccgtttacgg

SEQ ID NO: 323881 - DNA, 553 bp, Homo sapiens
  misc_feature: GZ8MTXP02F7AB4.4.39.D06.1.454.CMB.2.raw
  modified_base (430)..(430): a, c, t, g, unknown or other
  misc_feature (430)..(430): n is a, c, g, or t
tcagagcactgtagcacgaccggtgctcgatttagtgacatctcgcagttctttggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttataactatgtctctgtaccaacaacacccagcaaacgccccaaatcaatattatgagtcactaagcgccctcaggggtccctgatcgcttcctctcgcctccaagctggcaacacggcctccctgacccgtctctgggcctccgaggctgagatgaggctgattattattgcagtctacgattagngacaggctaagttacaagttgtagaagttacgttcgggacggaacgggaaacctaaaacgtcggaacccgttaccgtaaggtaccaacggaccccgaaagggtccctcggtcccccgttacgg

SEQ ID NO: 323882 - DNA, 522 bp, Homo sapiens
  misc_feature: GZ8MTXP02JCRHB.4.39.D06.1.454.CMB.2.raw
  modified_base (323)..(323): a, c, t, g, unknown or other
  misc_feature (323)..(323): n is a, c, g, or t
  modified_base (454)..(454): a, c, t, g, unknown or other
  misc_feature (454)..(454): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctcctggtaccaacaacacccaggcaaagcccccaaatcataatttatgagtcactaagcggccctnaggggtccctgatgcttctctgcctccaaggctggcaacacggcctccctgacccgtctctgggcctccgaggcctgaggatgaggctgattattattgcagctacagtatgcgaggcaagttacaatgtnatagttcggagtacgggaccaacgtcgaccgtcgtaagtcacgcccgaaggcctcgacccccgttccg

SEQ ID NO: 323883 - DNA, 580 bp, Homo sapiens
  misc_feature: GZ8MTXP02H2XQD.4.39.D06.1.454.CMB.2.raw
  modified_base (229)..(229): a, c, t, g, unknown or other
  misc_feature (229)..(229): n is a, c, g, or t
  modified_base (301)..(301): a, c, t, g, unknown or other
  misc_feature (301)..(301): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcaggcacagggtcctgggcccagtctcgccctgactcagccctccctccgcgtccgggtctcctggacagtcagtcaccatcctctgcactggaaccngcagtgtacgttggtcttaataactatgtctctgtaccaacaacaccagacaacgaccccaatcataattangagtcactaagccgccctgacgggtccctgactcgtcttcctctcgcctacgagctcggcaacgccggtccctccgtcgaccgtctcgtcggcctcgacgctggagtagtgaggtctagtatttagttattcgactacggtctacaagttacgtgcgagtacgtaagttaacaagtgtagtaagttacggttacgggacggtaacgggaacctaaacgtacggtacccgtacgtaacggtaccgacggtacccgacggtcccgtccgcccccgttaccg

SEQ ID NO: 323884 - DNA, 556 bp, Homo sapiens
  misc_feature: GZ8MTXP02JVWFZ.4.39.D06.1.454.CMB.2.raw
  modified_base (303)..(303): a, c, t, g, unknown or other
  misc_feature (303)..(303): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacaacacccaggcaaacgccccaaatcataattangagtcactaagcgccctcgagggtccctgatcgtcttcctctgcctcaaggctggcaacgacggcctccctgacccgtctcgtcgggcctccgaggctgaggatcgagctgattattagttgcgagctcgatatgacaggctaggtactaagtgtagtacttagttacgggcggaaacgggtaacctaaaacgtcgaaccccgtcgtaacgggtacaacggaccccgaaggtcctaccggtcccccgtccggg

SEQ ID NO: 323885 - DNA, 630 bp, Homo sapiens
  misc_feature: GZ8MTXP02I0OFH.4.39.D06.1.454.CMB.2.raw
  modified_base (298)..(298): a, c, t, g, unknown or other
  misc_feature (298)..(298): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttataactatgtctctgtaccaacaacaccagacaacgccccaaatcatattangagtcataagccgccctcgacgggtcctgactcgtcttcctctcgccctacgaaggctcggaccaaaccgaccggcccttaccccgcgtaccccgttcgttccgtcggggtcccttacccgagttcggccgttaggaaggtactagggaacgggtcttaggtaattttaagttattcggactacgtcttacatatgacgaggactagttaacagtagtagtagttacggttacgggaacgggtaaacggaaacccgtaaaacgtcggtaacccgttaaccggtaacggtaccgaaccggaccccgaaacggtcccgtacccggtacccccgg

SEQ ID NO: 323886 - DNA, 517 bp, Homo sapiens
  misc_feature: GZ8MTXP02FGMOB.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgtttggtcgttataactatgtctcctggtaccaacaacacccagcaaacgcccccaaattcataatttatgagtcactaagcggccctcaggggtcccctgatcgcttcctctgcctccaaggctggcaacacggcctccctgaccgtctctgggcctcccaggctgaggatgaggctgattattattgcagctcatatgcaggcagttacaatgtgatattcggacgagggaccaaaacgtcgaccgtccaaggtcacgcccaaggcctcgccccctcgg

SEQ ID NO: 323887 - DNA, 621 bp, Homo sapiens
  misc_feature: GZ8MTXP02H0GZW.4.39.D06.1.454.CMB.2.raw
  modified_base (306)..(306): a, c, t, g, unknown or other
  misc_feature (306)..(306): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctggtaccaacaacacccagacaaacgccccaaatcataatttanagagtcactaagcggccctcgacgggtcctgactcgtcttcctctcgtcctaccaaggctcggctaaccgacggccctcccgtgacccgtctccgtcgggcctccgaggtcgtaggaggtagtggacggtctagttatttattagtttcgctagtacctatattagtaggaccgaaggtacctaaaggtttaacaaagttggtaagtaatttacgggttaccggggacggtaacgggaaaccctaacgtaccgtaaccgtaccgtaaggttacccgacggtacccgaaacggtcccgtcccgtacccccgtccgg

SEQ ID NO: 323888 - DNA, 559 bp, Homo sapiens
  misc_feature: GZ8MTXP02HG4L5.4.39.D06.1.454.CMB.2.raw
  modified_base (403)..(403): a, c, t, g, unknown or other
  misc_feature (403)..(403): n is a, c, g, or t
  modified_base (426)..(426): a, c, t, g, unknown or other
  misc_feature (426)..(426): n is a, c, g, or t
  modified_base (454)..(454): a, c, t, g, unknown or other
  misc_feature (454)..(454): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataaatttatgaggtcactaagcgccctcaggggtccctgatcgcttcctctgcctcaagctgcaacacggcctccctgaccgtctctcgggctcccgagcgtagngatgagctgattattagttgacngtctacatatacgcgtagactagttaanagtgtagtactacggtacggacggaacggtaaacctaacgtaccgtaccgttaccgtaacggtaccgaacgtacccgaacggtcccgtacccggtacccccgtcg

SEQ ID NO: 323889 - DNA, 547 bp, Homo sapiens
  misc_feature: GZ8MTXP02FHOGT.4.39.D06.1.454.CMB.2.raw
  modified_base (416)..(416): a, c, t, g, unknown or other
  misc_feature (416)..(416): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacaacacccaggcaaacgccccaaattcaataattatgagtcactaagcgccctcgacggggtccctgatcgtcttccctctgcctccaaggcctggccaacgacggtcctccctgaccgtctcgtgggcctcccgaggctggaaaggntcggaaggtctagatttattagttgcagctcaatatgcaggtcagttacaagttgatatagtcgggacggaagggaaccctaaacgtcgacccgttcgaaggtcaacgccctaagcctaccgccccttcgg

SEQ ID NO: 323890 - DNA, 600 bp, Homo sapiens
  misc_feature: GZ8MTXP02GKE2B.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacaccagacaaacgccccaaatcataattatgagtacactaagcggccctcgacgggtccctgactcgtcttcctctcgcctaccgaaggcctgggccaaaccgaccggtccctcccgtcgacccgtctcgtcgggcctccgaggctggagtatggagtctagtattattattgcagtctacattagtgcgaggtctaagttaacaagttggtagtaacgttacggttacgggacgggtaaacggggtaaccctaaaacgtccggaacccgttacggtaacggtaccaacggaccccgaaacggtcctacccggtcccccgtttaccgg

SEQ ID NO: 323891 - DNA, 592 bp, Homo sapiens
  misc_feature: GZ8MTXP02FGP3T.4.39.D06.1.454.CMB.2.raw
  modified_base (338)..(338): a, c, t, g, unknown or other
  misc_feature (338)..(338): n is a, c, g, or t
  modified_base (406)..(406): a, c, t, g, unknown or other
  misc_feature (406)..(406): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgtaccaacacaccagcaaacgccccaaatcatattatgagtcactaagcgccctcaggggtccctgatcgcttcctctncctccaaggctgggcaacaccggcctcccgtgaccgtctctcggggcttcccgaggctggacggtagngagtctagtatttattagttcgcacgtctactatagtcgacgtacggtactaacgttaaactaagttgtagtaacgttacggtaccgggaacgggtaacgggaaaccctaaaaccgtccggtaacccgtaccgtaacggtaccgaacggtaccccggaacgtcccgtaccccgcccccggttacgg

SEQ ID NO: 323892 - DNA, 526 bp, Homo sapiens
  misc_feature: GZ8MTXP02JBT1T.4.39.D06.1.454.CMB.2.raw
  modified_base (229)..(229): a, c, t, g, unknown or other
  misc_feature (229)..(229): n is a, c, g, or t
  modified_base (300)..(300): a, c, t, g, unknown or other
  misc_feature (300)..(300): n is a, c, g, or t
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcgttataactatgtctctgtaccaacacaccagacaaacgccccaaatcataattangagtcactaagcgccctgacgggtccngatcgcttccnctcgccctacgaggctggccaacgcggccctcccgtgaccgtcncgtggcctccgagctgagntgagctagatttattagtgcagtctacatatgcaaggtctagtacaagtgagtattaggtcggacggaacgacctaacgtccgaccgtacgtaacgcaacgacccgaagtcctaccgccccctag

SEQ ID NO: 323893 - DNA, 589 bp, Homo sapiens
  misc_feature: GZ8MTXP02JX6JQ.4.39.D06.1.454.CMB.2.raw
  modified_base (310)..(310): a, c, t, g, unknown or other
  misc_feature (310)..(310): n is a, c, g, or t
tcagagcactgtagcacgaccggtgctcgatttagtgacatctcgcagttctttggggggggtctcaggaggcagcgctctcaggacgtcaccaccatggcctgggctgtgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaaacaaccacccaggacaaacgcccccaaattcataatttangagtcactaagcggccctgacgggtccctgatcgcttcctctgccctcagctgcaacaccggccctcccgtgacccgttctccgtgggcccttcccgaggtctggaggatggacggcttgtatttattagttgacgagtcctatatatgccgagggtctaagttacaagttgtagtaattacggttcgggacgggaacgggaaacctaaaacgtcggtaacccgtccgtaagggtacccgacggaccccaaggggtccctaccggtcccccgtttccgg

SEQ ID NO: 323894 - DNA, 578 bp, Homo sapiens
  misc_feature: GZ8MTXP02JTFCE.4.39.D06.1.454.CMB.2.raw
  modified_base (229)..(229): a, c, t, g, unknown or other
  misc_feature (229)..(229): n is a, c, g, or t
  modified_base (384)..(384): a, c, t, g, unknown or other
  misc_feature (384)..(384): n is a, c, g, or t
  modified_base (459)..(459): a, c, t, g, unknown or other
  misc_feature (459)..(459): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccngcagtgacgttggtcgttataactatgtctctggtaccaacaacacccaggcaaacgccccaaattcataatttatgagtcactaagcggccctcgagggtccctgactcgtcttcctctgccctaccaaggctggccaacgacggccctcccgngaccgtctcgtcgggccttcccgaggtcctaggagatcggaaggctagtattagttattcgctagcttcaagttntacgacgagtactagttactagtgtagtacgttacggtacgggacggaacggtaacctaaacgtacgtaccgtacgtaacgtacgaaccggtacccgaacgtcccgtaccgccccgtcg

SEQ ID NO: 323895 - DNA, 629 bp, Homo sapiens
  misc_feature: GZ8MTXP02IGF0E.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacacacccaggacaaacgcccccaaatcataatttatgagtacactaagcgccctcgagggtccctgactcgcttcctctcgcctcgaaggctggccaaccacggccctccctcgacccgtctctcgggctcccgaggcctaggacgtatcggaggtcctagtattatttagttcggactaggtctactattaagttcgacgtacgggtactaacgtttaacgaagttcggttacgtaacgtttaacggtttccgggggacggtaaaaccggggaaccctaaaaacgtcggtaacccgttaccgtaacgggttacccaacggtaccccgaaaggggtcccttaccggccccccgtttaacgg

SEQ ID NO: 323896 - DNA, 764 bp, Homo sapiens
  misc_feature: GZ8MTXP02I4OSL.4.39.D06.1.454.CMB.2.raw
  modified_base (297)..(297): a, c, t, g, unknown or other
  misc_feature (297)..(297): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcaggcacagggtcctgggcccagtctgccctgactcagccctccctccgcgtcccgggtctcctggacagtcagtcaccatctcctgcactggaaccagcagtgacgttggtcgttataactatgtctctgtaccaacacaccagcaaagccccaaatcatattangagtcactaagcgccctcgacgggtccctgactcgtccttcctctcgtcctaccgaaggccttcgggcctaaaccgacccgggtcccttcccccgtcgtacccgttcctccgttcggggtccttcccgaggtccgtaggaaggtaagttgggaacggtcgttaggtaaattttaagtttaaacgtttcggacctacggtacctttaccgtaatttaaacgtccgggaccgtaaagggggtacccttaaaaaggggttttaaacctaaaaaggtttcgggtttaacggttaaaagtttaaccggggttttaccgggggaaccgggggttaaaaccgggggaaaaccccttaaaaaccgggttacccgggtaacccggttacccggttaaaacggggtacccgtaaaccgggtaaacccccgaaaacggggtaccccttccccgggtaacccccccggttttacccggg

SEQ ID NO: 323897 - DNA, 563 bp, Homo sapiens
  misc_feature: GZ8MTXP02JZF6P.4.39.D06.1.454.CMB.2.raw
  modified_base (306)..(306): a, c, t, g, unknown or other
  misc_feature (306)..(306): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttaataactatgtctctggtaccaacaacacccaggcaaacgcccccaaattcataatttangagtcactaagcggccctcgacggggtccctgatcgcttcctctcgcctccaaggcctggccaacgaccggccctccctgacccgtctcgtcggggcctccgaggctggacggatggaggctgatttattattgcagctcatatgctaggctaagttacatgtagattagttcgggacgggtaacgggaaccaaacgtcggacccgtacgtaacgggtaccaacggacccaagggtccctaccggccccccgttcgg

SEQ ID NO: 323898 - DNA, 688 bp, Homo sapiens
  misc_feature: GZ8MTXP02GP3S3.4.39.D06.1.454.CMB.2.raw
  modified_base (319)..(319): a, c, t, g, unknown or other
  misc_feature (319)..(319): n is a, c, g, or t
  modified_base (553)..(553): a, c, t, g, unknown or other
  misc_feature (553)..(553): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtccaccatctcctgcactggaaccagcagtgacgttggtcgttataactatcgtctccgtacgtaaccaacaaccacccgagaccaaaccgacccctaaattcaattaaatttnagacgtacaacgtaacggccgtccctacggaccgggtccctagactccgtcttcccgtcgtcgtccctacgaacggtccgtaacgggaccgtcccgggtcccttaccccgtcgtaccccgtcgtcgggtcggggtaccctccggaggtccgtagggaacggtacgtcgggacggttcttaagttaatttacgttacgttcgacctacgtcttacgaattacgtcgacgaacgtnttaaacgtaataagttcgtaagtagtttacggaccggggacggaaaccgtaaacctaacgtccgtaacccgttaccgtacggtaaccgaacgacccggtaacggcccttaccccggtcccccgttacggtacccc

SEQ ID NO: 323899 - DNA, 557 bp, Homo sapiens
  misc_feature: GZ8MTXP02GKQ1A.4.39.D06.1.454.CMB.2.raw
  modified_base (424)..(424): a, c, t, g, unknown or other
  misc_feature (424)..(424): n is a, c, g, or t
  modified_base (482)..(482): a, c, t, g, unknown or other
  misc_feature (482)..(482): n is a, c, g, or t
  modified_base (543)..(543): a, c, t, g, unknown or other
  misc_feature (543)..(543): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacaacacccaggacaaacgacccccaaatcataatttatgaggtacactaagcgaccctcgacgggtccctgatcgtcttcctctcgcctccgaaggtctggcctaacgacggtccctcccgtgacccgtctcgtcgggctccgaggtctgaggtangaggcgttgtattacttagttgacagtcgtacatatcgacaggctaagttacaatgtnactgttacggcggtaaacgggacaaacgtcgaccgttacgaaggtacacgaccaagggccnccgtcccccgtacg

SEQ ID NO: 323900 - DNA, 619 bp, Homo sapiens
  misc_feature: GZ8MTXP02FX4DH.4.39.D06.1.454.CMB.2.raw
  modified_base (302)..(302): a, c, t, g, unknown or other
  misc_feature (302)..(302): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacaacaccagacaaacgcccctaaatcataattanagagtacactaagcgccctcgagggtccctgatcgtcttccctctcgccctacaaggccttcgggaccaaccgaccggtccctcccgtgacccgttctcgtacggggtcctaccgaggtcgttaggaggtatgggaacgtcgttagtaatttacgtttaagtgaccgtagtctactaattagtcgacgtaaggactaaacgttaacaagttgtagtaattacggttacgggacggtaaacgggaaacctaaacgtacgtaacccgtaccgttaagggacaccgtacccgaaggtcccgtaccggtcccccgttacgg

SEQ ID NO: 323901 - DNA, 568 bp, Homo sapiens
  misc_feature: GZ8MTXP02IFRRV.4.39.D06.1.454.CMB.2.raw
  modified_base (327)..(327): a, c, t, g, unknown or other
  misc_feature (327)..(327): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaaccagcagtgacgttggtcttataactatgtctcctggtaccaaacaacacccaggcaaagcccccaaaattcaataaatttatgagtcataacgcgccctnaggggtccctgatcgctcctctgcctccaaggctggcaaacncggccctcccngaccgtctcgtcgcctccgaggctggaggatgagcgtgtattattattgtcacgtctactactatcgacgacggacgtagttaactaagtagtagtaacgtagttacggtacgggaacgggaaaccgaaaccgtacgtaccgtaccgtaacgtacgacgaccgaaccggaccgtccgtaccccgtccg

SEQ ID NO: 323902 - DNA, 552 bp, Homo sapiens
  misc_feature: GZ8MTXP02I9N2G.4.39.D06.1.454.CMB.2.raw
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
  modified_base (435)..(435): a, c, t, g, unknown or other
  misc_feature (435)..(435): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctctgtaccaacacaccagacaaacgccccaaattcataattangagtcactaagccgccctcgagggtcccngactcgcttcctctcgcctccaaggctggccaacgaccggtccctcccgtcgaccgtctcgtgggcctccaggctgagatgagtctgtattattatgctagcctanatagtcgataggctaagttacaagtgtgtaagtttaggtcgggacggtaaacggacctaaacgtcgaacccgttacgtaacggtcacgacccgtaacgccttaccggcccccttcgg

SEQ ID NO: 323903 - DNA, 681 bp, Homo sapiens
  misc_feature: GZ8MTXP02JU20A.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagtctccctccgcgtccgggtctcctggacagtcagtcaccatcctctgcactggaaccagcagtgacgttggtcgttaataactatgtctctggtaccaacacacccagacaaacgccccaaatcataattatgagtcataacgcgccctcgacgggtcctagatcgtcttcctctcgacctaccgacggccgtggaccaaccgaaccgggtcccctcccgtcggtacccgtccgttccgtcggggtcccttacccggaaggtccgttaggaaggtagttcgggacgggtcttaggtaacttttaagttaagtttcgaacgtacgtacctactaagtaattcgacgtacggtacgtaaaggttaactaagttcgaagttaagttacgttaccggggacgggtaacgggaaaaccctaaacggttccgtaaaacccggttaccgttaaggggtacccaaccgggtacccggaaaaccgggtcccctaacccgggtcccccgtttaacccggg

SEQ ID NO: 323904 - DNA, 570 bp, Homo sapiens
  misc_feature: GZ8MTXP02GESHM.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacaccaggcaaacgccccaaatcataattatgagtcactaagcgccctcgacggggtccctgatcgcttcctctcgcctccaggctggcaacacggcctccctgaccgtctctcgggctccgagctgacggatgaggctgtatttagttatgcagctcatatcgacgaggctagttacaagttgtagtactaggtttccggggacgggtaaacgggtaacccaaaccgttcggacccgttaccgtaacggggttccaacggtaccccgaaggtccgtacccggccccccgtttaccggg

SEQ ID NO: 323905 - DNA, 529 bp, Homo sapiens
  misc_feature: GZ8MTXP02FIWY1.4.39.D06.1.454.CMB.2.raw
  modified_base (228)..(228): a, c, t, g, unknown or other
  misc_feature (228)..(228): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttataactatgtctctggtaccaacaacacccaggacaaacgaccccaaatcaataattatgagtcactaagcggccctcgacggggtccctgatcgcttcctctgcctcagctggcaacacgcctcctgaccgtctcgtcgggcctccgaggctgagatggaggctgtacttattattgcagctcatatgnaggctagtacaagtgtanattgtacggacggaacggtaaccaaacgtcgaccgtccgaaggtaccgacgaccccgtaagcctccgccccctcgg

SEQ ID NO: 323906 - DNA, 583 bp, Homo sapiens
  misc_feature: GZ8MTXP02GHCWE.4.39.D06.1.454.CMB.2.raw
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctgtaccaacaacacccagacaaacgccccaaatcataattangagtcactaagcgccctcgacgggtccctgatcgtcttcctctcgcctccaaggctggccaacncggccctcccgtgaccgtctcgtcgggctcccgaggctggaggtatggaggctagattattattgacagctcatatcgacgtaggactaagttaacaagtgtagtacgttagttacgggacgggaacgggtaaacccaaaccgttacggaaccccgttaccgtaacggttacaaccggtaccccgaaacgggtccttacccggcccccgttacggg

SEQ ID NO: 323907 - DNA, 547 bp, Homo sapiens
  misc_feature: GZ8MTXP02IPB6K.4.39.D06.1.454.CMB.2.raw
  modified_base (430)..(430): a, c, t, g, unknown or other
  misc_feature (430)..(430): n is a, c, g, or t
  modified_base (459)..(459): a, c, t, g, unknown or other
  misc_feature (459)..(459): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaaacaacaccccaggaccaaagcccccaaaattcaataatttatgaggtcactaagcggccctcaggggtcccctgatcgtcttcctctgcctccaaggctggcaacacggccctccgtgaccgtctctgggctccgagctgagatgaggctgattattatgnagctacatatgcaggcagttacaaagtgngtaatagttcgggacgggaagggaacccaaaacgtgacccgttacgtaaggtcaacgaccccgaaaggccttacggccccccgttcgg

SEQ ID NO: 323908 - DNA, 568 bp, Homo sapiens
  misc_feature: GZ8MTXP02GZLAN.4.39.D06.1.454.CMB.2.raw
  modified_base (284)..(284): a, c, t, g, unknown or other
  misc_feature (284)..(284): n is a, c, g, or t
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtcggaaccagcagtgacgttggtacgttatactatgtctctgtaccaacacaccagacaacnccccaatcataattngagtcataagcgccctgacgggtcccngactcgtctcctctgcctcgagtctggcaacgcggcctaccctgtaccgtctcgcggactcccgaggtctaggacgtatcggaaggtcctagtatttacttagttcgacgtagtccttagtaatagtcgacgtacggtacttaacgtatagtgtagtacgtacggtacggaacggtaacgaaaccgtacgtcgtaccgtacgtaacgtacgacgtaccgacgtcccgtacccgtcccgtacg

SEQ ID NO: 323909 - DNA, 604 bp, Homo sapiens
  misc_feature: GZ8MTXP02I5VK8.4.39.D06.1.454.CMB.2.raw
  modified_base (298)..(298): a, c, t, g, unknown or other
  misc_feature (298)..(298): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacacaccagcaaacgccccaaatcatattangagtcataagcgccctcgagggtccctgatcgcttcctctgcctacaaggctggcaacacggccctccctgacccgttctccgtcgggcctcccgaggtcctaggaacggatcggaacggtctaggtaatttatttaagttcgacaacggtccttactaagttaagtcggacgtagggtacctaaaggttaacctaaagttggttagtaattacggttcgggacgggtaacggaaacctaaacgtcggacccgttacgtaacggtaccacggtaccccgaaggtccctaccggtcccccgttacgg

SEQ ID NO: 323910 - DNA, 612 bp, Homo sapiens
  misc_feature: GZ8MTXP02H0IF6.4.39.D06.1.454.CMB.2.raw
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctcgcgtccgggtctcctggacagtcagtcaccatctcctgcactggaaccagcagtgacgttggtacgttataactatgtctctaggtaccaacaacacccagacaaacgccccaaattcaattaatttangacggtcaactaagccgcctcgacgggtcctagactccgctttccnctcgcctaccgaaggtcctagggccaaacgtaccggccctcccgtagtaccccggtctccggtcggccctccggaggtcctagggacgtagttggacggtactaggtatttattagtttacgctaagtccttaatagtacgtagacgacgtactaacgttaactagttagtaagttacgttacggtcgggacggaacggaacctaacgtcgtaccgtacgtaacggacaccgacccgtaggtccctccgtacccgtcg

SEQ ID NO: 323911 - DNA, 540 bp, Homo sapiens
  misc_feature: GZ8MTXP02JORQD.4.39.D06.1.454.CMB.2.raw
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
  modified_base (371)..(371): a, c, t, g, unknown or other
  misc_feature (371)..(371): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacacacccaggacaaacgccccaaatcataatttangagtcactaagcggccctcgacgggtccctgactcgcttccnctgctcagctgcacacggcctccgngaccgtctcgtcgggctccacggtcgtgacgatggagtctagtattattattgctagcttacattatgcgaggcattacgaatgtagtagtagttacggacgggaacggaccgtaaaacgtcgacccgtacgtaacggtacacggaccctaaggcctacgcccccgtcg

SEQ ID NO: 323912 - DNA, 617 bp, Homo sapiens
  misc_feature: GZ8MTXP02GB4PQ.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttaataactatgtctcctgtaccaacaacaccagacaaacgccccaaatcataattatgagtacactaagccgccctcgacggggtcctgacgtcgtcttcctctcgcctaccaggcgttagccaaaccgaccggccctcccgtcgacccgtctcgtcgggcctcccgaggtctaggaggtatggaggtcgtagtaactttattaagttcgactagtctacaattacgtcgacgaggtacttaagttacaaagttgttagtacgttacgttacggggaccggtaaacggtaacccgtaaaaccgtacggaccccgttacggtaacggtacgaaccggacccgtaacggcccgttaccccgtcccccgttaccgg

SEQ ID NO: 323913 - DNA, 615 bp, Homo sapiens
  misc_feature: GZ8MTXP02JEYWZ.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacaacacccaggacaaacgccccaaatcataattatgagtcataacgcgccctcgacgggtccctgactcgtcttcctctgcctaccgaaggcctgggccaaaccaccgggtccctcccgtagacccgtctccgtcggccttcccgaggtcctaggacggatggaaggtctagtactttattacgttgcgaagtctcgtaattagtcgacgtacggtacgtaaggtttaacaaagttgtagtaagttacggttacgggcggaaacggggtaaccctaaaacggtcgtaacccgtaccgtaacggtccgaacggtcccgaaacggcccgttacccgcccccgtttccgg

SEQ ID NO: 323914 - DNA, 639 bp, Homo sapiens
  misc_feature: GZ8MTXP02F7SB4.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttaataactatcgtctcctggtaaccaacaacacccagacaaacgccccaaattcataatttatgaggtcactaagccgccctcgacgggtccctgactcgtcttcctctcgtcctaccgaaggcctacgggccaaaccgaccggtcccttccccgtcgtacccgttccgtccgtcgggtcctacccgaggccgtaggaggtagtcggaggtcttaggttaactttaagtttagttcggactacggtccttacgtattagtcgacgaggtaaccgttaagttaacgtaagttgtagtaagttacgttacggggacgggtaaacggaaacctaaacgtacgtacccgttacgtaacgtacgacgtacccgacggtccgtccggcccccgttacgg

SEQ ID NO: 323915 - DNA, 597 bp, Homo sapiens
  misc_feature: GZ8MTXP02IOIYT.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtcccgggtctcctggacagtcagtccaccatctcctgcactggaaccagcagtgacgttggtcttataactatgtctcctgtaccaacaacacccagacaaacgcccccaaattcataatttatgaggtcactaagccggccctcgacggggtccctgatcgcttcctctgcctccaaggctggccaacaccggccctccctcgacccgtctcgtcgggctcccgaggcctggacggatggaggtctagtattagtttattgacagtctcatagtgcgagctagttactaagtgtagtagttacgttcgggacgggtaaacgggaaaccctaaaaccgtacggtaacccgttaccgtaacgggtacccaacggtaccccgaaaggtcccgttacccggtcccccgtttaccggg

SEQ ID NO: 323916 - DNA, 538 bp, Homo sapiens
  misc_feature: GZ8MTXP02IDKJV.4.39.D06.1.454.CMB.2.raw
  modified_base (305)..(305): a, c, t, g, unknown or other
  misc_feature (305)..(305): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacaacacccaggacaaacgccccaaattcataatttangagtcactaagcggccctcgaggggtccctgatcgcttctctgcctcagcngcacncgcctcccngacgtctctggctccagctgagatgagctgattattattgcagtctcatatgcgaggctaagttacaagtgtagtacgttagttcgggacgggtaacgggaacctaaacgtcgaacccgttcgtaacggtccaacggtaccccgaaaggccctcggcccccgttacgg

SEQ ID NO: 323917 - DNA, 661 bp, Homo sapiens
  misc_feature: GZ8MTXP02JHQ1R.4.39.D06.1.454.CMB.2.raw
  modified_base (301)..(301): a, c, t, g, unknown or other
  misc_feature (301)..(301): n is a, c, g, or t
  modified_base (439)..(439): a, c, t, g, unknown or other
  misc_feature (439)..(439): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtcccgggtctccctggacagtcagtcaccatctcctgcactggaaccagcagtgacgttggtacttataactatgtctctgtaccaacacaccagacaacgccccaaatcatattangagtcactaagcgccctcgagggtccctgactcgtcttcctctcgcctccgaaggtctacgggcctaaaccgaccgggtccccttcccgtacgacccgtttctccgtacggggcctcccgagggccttaggacggtancggtaaggtccttagtaagtttatttaacgttcgacaacggttcctactaaagtacgtggaccgtaaggtaccgtaaagttaaccgtaaatttggtaggtaactttagggttaccggggaacggggtaaacggtaaccccgtaaaacgtaccggtcccgttaacggttaacggggaaccaccggaacccgtaacggtcccgttacccgtcccccgttaccgg

SEQ ID NO: 323918 - DNA, 554 bp, Homo sapiens
  misc_feature: GZ8MTXP02FL7RL.4.39.D06.1.454.CMB.2.raw
  modified_base (284)..(284): a, c, t, g, unknown or other
  misc_feature (284)..(284): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtacgttataactatgtctcctggtaccaacacacccagcaaacnccccaaatcaatattatgagtcactaagcgccctcacggggtccctgatcgcttcctctcgcctcaaggcctaggccaaacaccggtcctacccgtgacccgtctccgtggggcctccgaggctggagatgagtctagatttattattgcagtctcatatgcaggacaagttacaatgtagtaagttacgttcggggacggaacggtaaaccaaacgttcgaacccgttacgtaaggaccaacgacccgaggcctccgcccccgttacgg

SEQ ID NO: 323919 - DNA, 522 bp, Homo sapiens
  misc_feature: GZ8MTXP02FQRIE.4.39.D06.1.454.CMB.2.raw
tcagagcactgtagcacgaccggtgctcgatttagtgacatctcgcagttctttggggggttctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacaccccaggcaaagcccccaaattcatatttatgaggtcactaagcggccctcaggggtcccctgatcgcttcctctgcctccaaggctggcaaacacggcctccctgaccgtctctggggctcccaggctgaggatgaggctgatttattattgcagctcatatgcagggcagttaacaaatgtgatattcggcggaggggaccaaaactgacccgtcctaaggtcagccccaaggctcgccccctcgg

SEQ ID NO: 323920 - DNA, 549 bp, Homo sapiens
  misc_feature: GZ8MTXP02JBZA5.4.39.D06.1.454.CMB.2.raw
  modified_base (373)..(373): a, c, t, g, unknown or other
  misc_feature (373)..(373): n is a, c, g, or t
  modified_base (428)..(428): a, c, t, g, unknown or other
  misc_feature (428)..(428): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacacacccagcaaacgccccaatcataatttatgagtcactaagcgccctgacgggtccctgactcgtcttcctctcgcctccgaaggctggcaacgcggcctccngaccgtctctcgggctccgaggctgagatcgaggtctgattacgttatgacagtntcattagtcgcgacggtctaagttaacgaatgtagtacgttacgttcgggacggtaacgggaactaaacgtcgtaccggttacaacggtacacgacccgtacgcgtaccgccccgttccgg

SEQ ID NO: 323921 - DNA, 559 bp, Homo sapiens
  misc_feature: GZ8MTXP02I3SXC.4.39.D06.1.454.CMB.2.raw
  modified_base (298)..(298): a, c, t, g, unknown or other
  misc_feature (298)..(298): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctctgtaccaacaacaccagcaaagccccaaatcatattangagtcataagcgccctcgacgggtccctgatcgcttcctctcgcctccaagctggccaacaccggtccctccctgaccgtctcgtcgggctcccgaggctggagatggaggctagattattattgcagtctacatatcgacaggctaagttacaaagtgtagtaattacgttacggggacggaaacgggacctaaaacgtcgaacccgttaccgtaacgggtccaacggacccgtaaaggcccgttaccgcccccgttcgg

SEQ ID NO: 323922 - DNA, 547 bp, Homo sapiens
  misc_feature: GZ8MTXP02GP9KK.4.39.D06.1.454.CMB.2.raw
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagttacgtggtcgttatactatgtctctgtaccaacaacaccagcaacgccccaatcatattangagtcactaagcgcctcgacgggtcctgactcgcttctcctgcctcgaaggctcggacaccnccggccctcccgtgtacccgtctcgtcgggcctcgaggctgagatgaggctagtattagttattgctagctacgatacgtgacgaggtctaagttacaattgtagtattacgttccggaggtacggaaactaacgtcgtaccgtacgttacgcgacggacccgaacggcctaccgtccccgtacggtacc

SEQ ID NO: 323923 - DNA, 640 bp, Homo sapiens
  misc_feature: GZ8MTXP02H81S5.4.39.D06.1.454.CMB.2.raw
  modified_base (339)..(339): a, c, t, g, unknown or other
  misc_feature (339)..(339): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaaccagcagtgacgttggtacgttataactatgtctctggtaccaacaacaccagcaaagccccaaatcataattatgagtacactaagcgcctcaggggtccctgactcgcttccnctcgcctccgaaggctcggacaaccgacggccctcccgtcgacccgtctcctcggggcctcccgaggtcctaggacggtatcggaaggtataggtatttaagttattgactagtcttacataagtcgacgagggtacctaaggtttaacaagttaggttacgtaaagttaaacgttttcgggggacggtaaacgggtaaacccgtaaaacggtaccgtaacccggttacccgtaacggggttacccgaaacgggtaccccgaaaacggtcccgttaaccggtcccccccggtttacccggg

SEQ ID NO: 323924 - DNA, 569 bp, Homo sapiens
  misc_feature: GZ8MTXP02JEOI4.4.39.D06.1.454.CMB.2.raw
  modified_base (304)..(304): a, c, t, g, unknown or other
  misc_feature (304)..(304): n is a, c, g, or t
  modified_base (437)..(437): a, c, t, g, unknown or other
  misc_feature (437)..(437): n is a, c, g, or t
  modified_base (449)..(449): a, c, t, g, unknown or other
  misc_feature (449)..(449): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtacgttataactatgtctcctggtaaccaacaacaccagacaaacgccccaattcataattangagtcataagcgccctcgacgggtaccctgactcgtcttcctctcgcctcacgctgcctaacaccggtcctaccctgaccgttctccgtcggcctccgaggctgaggactggagtctgtattattagtcgacngtctactaagtntagccgaggacgtagttaacatggtagtataggttcggacggaacggaacctaaactaccggtaccgtaccgtaaggtaccaacggtcccgaaacggtccgtaccgtcccccgttaccgg

SEQ ID NO: 323925 - DNA, 670 bp, Homo sapiens
  misc_feature: GZ8MTXP02IJO6Y.4.39.D06.1.454.CMB.2.raw
  modified_base (296)..(296): a, c, t, g, unknown or other
  misc_feature (296)..(296): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctcctgcactggaaccagcagtgacgttggtcttataactatgtctctgtaacaacacacccagcaacgccccaaatcatattangagtcataacgcgccctcgacgggtcctgactcgtcttcctctcgcctacaaggtccttacggcctaaaccgaccggtccctacccccgtcgtacccgtccgttccgtcggggtcctccccggtaagggtccgttgggaaaccggggtacgtacgggtaaagggtcctttaagggttaaacttttaaggttttaaacttttcgggaaacctacggttccctttacgtaattaaaccgttggacccgtaaaggggtcttaaacggtttaactaaagttggtagtaacgtttaacgttcgggacgggtaaacggaaacctaaacgtacgtaccgtacgtaaggtccaacggtccaaaggcctaccgtccccgttcg

SEQ ID NO: 323926 - DNA, 580 bp, Homo sapiens
  misc_feature: GZ8MTXP02I92N7.4.39.D06.1.454.CMB.2.raw
  modified_base (227)..(227): a, c, t, g, unknown or other
  misc_feature (227)..(227): n is a, c, g, or t
  modified_base (302)..(302): a, c, t, g, unknown or other
  misc_feature (302)..(302): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtcttataactatgtctcctggtaccaacaacacccaggacaaacgccccaaattcatattangagtcactagcgccctgacgggtccctgatcgtcttcctctcgcctaccgaagctcggcaaaccgaccggtccctacccgtcgtaccgtctccgtcgggcctcccgagcctaggacgatcggagctgagttatttagtgacagtctactagtatcgactaggctaagttaactaattcggtagtagttacgttacgggacggtaaacgggaacctaaaacgtcgaacccgttcgtaacggtccgaacgacccgaaggtcctaccgtcccccgtaccgg

SEQ ID NO: 323927 - DNA, 606 bp, Homo sapiens
  misc_feature: GZ8MTXP02G1KT0.4.39.D06.1.454.CMB.2.raw
  modified_base (306)..(306): a, c, t, g, unknown or other
  misc_feature (306)..(306): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggaccaacaacacccaggacaaacgccccaaattcaataatttangagtacaataagcggccctcgaggggtccctagtatcgtctccctctcgtcccacgtaaggcctacgacaaacgaccggtcccctaccccgtcgaaccccgtctccgtcgggtctacccgtagtctaggaaggatcggacgttctacgtaattattagtcgactacgtctagtacgtacgtacgtacgtacggtacgtaacgttaacgtaagtagtagtacgtacgtacggtacgggaacggtaaacgtaacgtacgtacgtacgtaacgtacgacgacgacgacgtccgtacccgtccg

SEQ ID NO: 323928 - DNA, 671 bp, Homo sapiens
  misc_feature: GZ8MTXP02ITK48.4.39.D06.1.454.CMB.2.raw
  modified_base (303)..(303): a, c, t, g, unknown or other
  misc_feature (303)..(303): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgtacgttggtcttaataactatgtctctgtaccaaacaacaccagacaacgaccccaatcataattangagtacataagccggtccctcgacggggtccctagtactccgtcttccctctcgccctacgaacggccgttacggcctaaaccgacccggtcccctcccccgtacgtaccccgttccttccgtccggggtccctacccggacggtccgtagggaacggagttggggaacggtcgttagtatttatttaagttggactacggtcttacgtaattagtcggacgtaacgggtactaaaggtttaaacaagttgtagtaacgttacgggttacggggacgggaaacggggtaaaccctaaacgtaccggtacccgttacgtaacggtacccgaacggtaccccgaaggtcccgtacccgtcccccgtacgg

SEQ ID NO: 323929 - DNA, 648 bp, Homo sapiens
  misc_feature: GZ8MTXP02I4HRS.4.39.D06.1.454.CMB.2.raw
  modified_base (311)..(311): a, c, t, g, unknown or other
  misc_feature (311)..(311): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcaggcacagggtcctgggcccagtctgccctgactcagccctccctccgcgtccggtctcctggacagtcagtcaccatcctcctgcactggaaccagcagtgacgttggtacgttaataactatgtctcctagtaccaaacaaccaccaggaccaaacgaccccaaattcataattangagtcataagcgccctgacgggtccctgactcgtcttcctctcgccctaccgaaggcctcggaccaacgacccggtccctcccgtcgaccgtctcgtcggcctccgacgcgtaggagtagtggacgtcgtagtatttagtttattcggactacggtactacgtagttaacgtacgacggtaggtactaaaggttaacagttagttagtaagttacggtttaccggggacggtaaacgggtaaacctaaaccggtacggtacccgtaccgttaaaccgggtccgtaaaccggaccccggtaaaacggtccccgtaccggtaccccccgtttaaccggg

SEQ ID NO: 323930 - DNA, 602 bp, Homo sapiens
  misc_feature: GZ8MTXP02GE6KH.4.39.D06.1.454.CMB.2.raw
  modified_base (304)..(304): a, c, t, g, unknown or other
  misc_feature (304)..(304): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgacgttggtcgttaataactatgtctctgtaccaacaacaccagacaaacgccccaaatcaataattangagtacataagcgccctcgacggggtccctgactcgtcttcctctcgcctacgaaggcctaggcaaccgaccggccctccccgtcgtacccgtctcgtcgggcctcccgaggctaggagtactggagtcgttagtatttatttagttgactagtctataagtatcggacaagggtactaaacgtttaacaagttgtagtaagttacggttcgggacgggtaaacggaaacctaaacgtccggtaccgtacgtaacgggtcaaccggtacccgaacgtcgtcccggtacccccgttcgg

SEQ ID NO: 323931 - DNA, 607 bp, Homo sapiens
  misc_feature: GZ8MTXP02FJ3WR.4.39.D06.1.454.CMB.2.raw
  modified_base (227)..(227): a, c, t, g, unknown or other
  misc_feature (227)..(227): n is a, c, g, or t
  modified_base (299)..(299): a, c, t, g, unknown or other
  misc_feature (299)..(299): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtcttataactatgtctcctgtaccaacaacaccagacaaacgccccaaatcataattangagtcactagcgccctcgacgggtccctgatcgtcttcctctcgcctaccgaacggcgtcggccgaaaccgaccggtccctcccgtcgacccgtctcgtcggggcctcccgaggctggagatggaggtctagtatttattattgactacgtctactaattagtcgacgaggtactaagttaactaagttgtagtaagttacggtaccggggtaacggaaacgggaaacccgtaaaacgtccggtaacccgttaccgtaacggtaccgaaccggtacccgaacggtccctcccggtacccccgttccgg

SEQ ID NO: 323932 - DNA, 569 bp, Homo sapiens
  misc_feature: GZ8MTXP02IUU08.4.39.D06.1.454.CMB.2.raw
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
  modified_base (411)..(411): a, c, t, g, unknown or other
  misc_feature (411)..(411): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcccttccctccgcgtcccgggtctcctggacagtcagtccaccatcctcctgccactggaaccagcagtgtacgttggtcgttataactatgtctctgtaccaacaacacccagaccaaacgcccccaaatcaatatttangagtcataagcgccctgagggtccctgatcgcttccctcngcctacaggctggcaacnccggcctcccnaccgtctcgtggcctcacggctaggagtagnggagtctagtatttattagttcgactacgtctataagtagtacgagacgacgtaacgttaacgtaagtagtagtacgttagttacggtacgggaacggaacgtaacgtacgtaccgtaccgtaacgtacgacgaccgacgtaccgtccgtcccgtccg

SEQ ID NO: 323933 - DNA, 677 bp, Homo sapiens
  misc_feature: GZ8MTXP02GPJ66.4.39.D06.1.454.CMB.2.raw
  modified_base (298)..(298): a, c, t, g, unknown or other
  misc_feature (298)..(298): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggaaccagcagtgtacgttggtcgttaataactatgtctcctgtaccaacacaccagacaacgccccaatcatattangagtcactagcgccctcgacgggtccctgactcgtcttcctctcgccctacgaaggcctacggactaaaccgaccggccctacccgtggacccgttctccggtcgggccttccgagggcgttaggaggtagtcgggacggtaccttagttaaacgtttatttaacgtttcgaccgtagttaccgtactaacgttagtaccggtacgaacggtacgttaaacgttaactaaagtttcggtaacgttaaggttacggtttaccgggggaacgggaaaccgggtaaaccctaaaaccgggtcccgttaaacccggttaccgtaaacggttaccgaaccggtaccccggacggtcccgtaccccggttacccccgtttcccgg

SEQ ID NO: 323934 - DNA, 623 bp, Homo sapiens
  misc_feature: GZ8MTXP02JCG2Y.4.39.D06.1.454.CMB.2.raw
  modified_base (517)..(517): a, c, t, g, unknown or other
  misc_feature (517)..(517): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtcccgggtctcctggacagtcagtcaccatcctcctgcactggaaccagcagtgacgttggtcgttataactatgtctctgtaccaacaacacccagcaaacgccccaaatcatattatgagtcataagcgccctcagggtccctgatcgtcttcctctcgcctacgaacggtctgggccaaaccaccgggccctcccctgacccgttcgtccgtcggggccttcccgagggtccttacggaaccgagttggaacgggtccttagtatttatttagttcgacctacgtcttacgtataagtgaccgtagggtccaggtttaaccaaattgggtntaattacgttccggggacgggtaacgggaaacctaaacgtaccggaacccgttaccgtaagggtaccgaacgaccccgtaaagggccttaccggcccccgttccgg

SEQ ID NO: 323935 - DNA, 575 bp, Homo sapiens
  misc_feature: GZ8MTXP02GOK68.4.39.D06.1.454.CMB.2.raw
  modified_base (305)..(305): a, c, t, g, unknown or other
  misc_feature (305)..(305): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttaataactatgtctcctggtaccaacaacacccagacaaacgccccaaatcataattangagtcactaagcgccctcgacggggtccctgactcgtcttcctctcgcctcgaagctggccaacgaccggccctccctcgaccgtctcgtggggcctccgaggctaggacggatggacggtctagtatttattattgcagtctacatagtgacaggctaagttaacaagtgtagtattaggttcgggacggtaaacggggaacctaaacgtcgtacccgttaccgtaagggtccaacggacccgaaggccctaccggtcccccgttacgg

SEQ ID NO: 323936 - DNA, 671 bp, Homo sapiens
  misc_feature: GZ8MTXP02IO7D0.4.39.D06.1.454.CMB.2.raw
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctctgtaccaacaacaccagacaaacnccccaaattcataaatttangagtacactaagccggtccctacgacggggtccctgactcgtcttcctctcgccctcaaggcctgccaaacaccggccctcccgtacgccgtctccgtcgggcctccgacggtcgtggaacggtagtacgggtacggtccgttagggtaactttaacgttttaagtttcgggtcctaacgggtcttaccgtattaacgtaggtccgaagggtaccgtaaacggtttaactaaagttggtagtagttacggtttaccgggggaccggtaaaacggggaaccgtaaaaccgtaccggtaacccgttacccggtaaaggtccgaaccggtacccgaacgggtcccgtacccgtacccccggtttcccgg

SEQ ID NO: 323937 - DNA, 571 bp, Homo sapiens
  misc_feature: GZ8MTXP02IXW8G.4.39.D06.1.454.CMB.2.raw
  modified_base (463)..(463): a, c, t, g, unknown or other
  misc_feature (463)..(463): n is a, c, g, or t
tcagagcactgtagcacgaccggtgctcgatttagtgacatctcgcagttcgtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggaaccagcagtgacgttggtcttataactatgtctctgtaccaacacaccagacaaagccccaatcataatttatgagtcactaagcgccctcgacgggtccctgatcgtcttcctctcgcctaccgaggcctggccaacgaccggtccctccctcgaccgtctcgtcgggctccgagctgagatggagtcgtgattattagttcgcgtagccttacgtatatgcaggtctaagttanaaagtgtagtaagttacgttcggggacgggtaacggaaaccaaacgtcgtaacccggttacgtaaggttcccgaacggacccgaaggtcccgtccgtacccccgttcg

SEQ ID NO: 323938 - DNA, 669 bp, Homo sapiens
  misc_feature: GZ8MTXP02F8DBN.4.39.D06.1.454.CMB.2.raw
  modified_base (297)..(297): a, c, t, g, unknown or other
  misc_feature (297)..(297): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacacaccagacaacgccccaatcataattangagtcactaagcgccctgacgggtccctgattgtcttcctctcgcctacaaggcctggccaacgaccggccctcccgtcgacccgtctcgtcgggcctccgaggtcctaggagtatgggacggtctagtacgtttatttagtcgacgtaacgtctactaattagtcggacgtaacggtacgtaaacggtttacctaaaggtttcggtaagttaaacggtttaccgggtttaccgggggaaccgggggttaaaaccgggtaaaacccgttaaaaccggttccgggtaaccccggtttaacccggtaaagggtacccgaaccggttaacccccggaaacgggttcccgtaccccggtccccccgtttaaccggg

SEQ ID NO: 323939 - DNA, 608 bp, Homo sapiens
  misc_feature: GZ8MTXP02FWON6.4.39.D06.1.454.CMB.2.raw
  modified_base (284)..(284): a, c, t, g, unknown or other
  misc_feature (284)..(284): n is a, c, g, or t
  modified_base (298)..(298): a, c, t, g, unknown or other
  misc_feature (298)..(298): n is a, c, g, or t
  modified_base (425)..(425): a, c, t, g, unknown or other
  misc_feature (425)..(425): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtacgttataactatgtctctgtaccaacaacaccagacaacncccaatcatattangagtcactagccgccctcgacgggtccctgatcgtcttcctctcgcctacgaggcctacggaccaaccgaccggcccctcccgtacgacccgttcgtcgtcgggcctccggaggtctaggaggtagnggaaggtcttagtaatttagtttagttcggactagtcttactaattagtcgacgacggtacttaagttactaagttgtagtaagttacggttcggggacgggaacggtaaacctaacgtacggtacccgttacgtaacggtacgaaccggaccgtaacggtccgtacccgacccccggtttcg

SEQ ID NO: 323940 - DNA, 599 bp, Homo sapiens
  misc_feature: GZ8MTXP02GH4MZ.4.39.D06.1.454.CMB.2.raw
  modified_base (251)..(251): a, c, t, g, unknown or other
  misc_feature (251)..(251): n is a, c, g, or t
  modified_base (295)..(295): a, c, t, g, unknown or other
  misc_feature (295)..(295): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactntgtctctgtaccaacaacaccagacaacgccccaatcatattangagtcactaagccgcctcgacgggtcctgactcgtcttcctctcgcctacgaaggctacgggccaaccgaccggtcccttcccgtcgacccgttctcgtcggggcctacccgaggtccgtggaggtacgtgggaagtcttaggtaatttagttacgttcgactacgtctacgattagtcgacgtaggtacctaagttactaagttgtagtagttacgtacgggacggaacggtaaacctaacgtacggtacccgtacgtaacggtaccgacggacccgaacggtccgtcccgtccccgttacgg

SEQ ID NO: 323941 - DNA, 640 bp, Homo sapiens
  misc_feature: GZ8MTXP02IFBGI.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtacttataactatgtctctgtaccaacaacaccagacaaacgccccaaatcatattatgagtcataagcgccctcgacggggtccctgactcgtcttccctctcgtccctaccgaaggcctacgggccaaccgaccgggcccttccccgtcgacccgttctcgtcggggctcccgaggtcctaggacggtatggaacggtcttaggtatttaagttaagtttcggctaacggtccttacgtaattaacgtcgtaccgaagggtcttaaacggtttaactaaagttgtaacgtagttaacggttcgggacggtaaacggggaaaccctaaacgtacggtaacccgtacgttaacgggtccaaccggtacccgaaggcccgttaccgccccccgttacgg

SEQ ID NO: 323942 - DNA, 643 bp, Homo sapiens
  misc_feature: GZ8MTXP02GD3SR.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacacaccagacaacgaccccaatcaataattatgagtcaactaacgccgccctcgacggggtccctgactcgtcttcctctcgcctaccgaaggctcggccaacgaccggtccctcccgtcgacccgtctcgtcgggtcctccgaggctggaaggtagtcggaggtcttaggtaatttagtttacgttcgactaacggtcttacatttaacgcggtacgtacgggtaccgtaaagtttacaaagttggtagtaagttacggttcgggggaccgggtaaacggggtaaacctaaaccggtaccggtaacccggttaccgtaacggttaccgaacggtacccccggaacggtcccgtacccggtaccccccgtttccgg

SEQ ID NO: 323943 - DNA, 657 bp, Homo sapiens
  misc_feature: GZ8MTXP02G5Z9B.4.39.D06.1.454.CMB.2.raw
  modified_base (306)..(306): a, c, t, g, unknown or other
  misc_feature (306)..(306): n is a, c, g, or t
  modified_base (469)..(469): a, c, t, g, unknown or other
  misc_feature (469)..(469): n is a, c, g, or t
tcagagcactgtagcacgaccggtgctcgatttagtgacatctcgcagttctttggggggggtctcaggaggcagcgctctcaggacgtcaccaccatggcctgggctctgctcctcctccaccctcctcactcagggcacagggtcctgggcccagtctgccctgactcagccctccctccgcgtccgggtctcctggacagtcagtccaccatctcctgcactggaaccagcagtgacgttggtcttataactatgtctctgtaccaaacaacaccagaccaaacgccccaaatcaataattangagtacaactaacgccgaccctcgacgggtccctagactccgtcttccctctcgtacccctacgaaacggccttacgggccaaaccgccgggtcccttaccccgtaccgacccgtctccgtcggggtaccttcccgaggtcttaggaacgtatggaacggttntagtatttagttagtcgagtacgtctagtagtagtcgaacgtaggtaacttaagttaacgtagtcgtaggttaaacgttacgggtaccgggaacggtaaacggtaaaccgtaaccgtaccggtaccgtaaccgtaacggtaccgtaaccgtacccggtaacggtcccgtaccccggtaccccgttacg

SEQ ID NO: 323944 - DNA, 553 bp, Homo sapiens
  misc_feature: GZ8MTXP02FLQXI.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttataactatgtctcctgtaccaacaacacccagacaaacgccccaaatcataattatgagtcactaagcggccctcgacggggtccctgatcgtcttcctctcgcctaccaaggctggcaaccgaccggccctccctgacccgtctcgtcgggcctccgaggctgaggatggaggtctgtattattatgcagctactatatgcaggtctagttacaagtgtagtatacgttcgggacggtacgggaacctaaacgtcggaccgtaccgtaaggtaccacgaccccgaaggtcctaccgcccccgttacg

SEQ ID NO: 323945 - DNA, 645 bp, Homo sapiens
  misc_feature: GZ8MTXP02FSWMA.4.39.D06.1.454.CMB.2.raw
  modified_base (294)..(294): a, c, t, g, unknown or other
  misc_feature (294)..(294): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgccactggaaccagcagtgacgttgtcgttataactatgtctcctgtaacaacaacaccagacaacgacccaactnataatttatgaggtcataacgcggccctcgaggggtcccctgatccgtctaccccctcctcgcctccaacggacgtcggccgaaccgacggtccctccccctcggtaacgttcccgtcgtcgggggtaccttcccgtacgggacgtcggtaaggaagtccggtaaggtccgtttgaaatttatttacgtttacgccgaaggtccttacgtaattacgttagaccgaagggtcctaaacgttacgtaaaatgttaccgtaagttacgtttacgggacgggaacgggtaaaccaacgttaacgcccggttaaccgtaagtacgacacccggaacgtctcccgtcccgtcccgg

SEQ ID NO: 323946 - DNA, 540 bp, Homo sapiens
  misc_feature: GZ8MTXP02HQUVT.4.39.D06.1.454.CMB.2.raw
  modified_base (303)..(303): a, c, t, g, unknown or other
  misc_feature (303)..(303): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagcaaagccccaaattcataatttangagtcataagcgccctcgagggtccctgatcgtcttcctctcgcctcaaggctggcaacacggcctccctcgaccgtctctgggcctccgaggctgaggatgaggctgaattattattgcagtctctatatgcaggctaagttactaatgtagtattagttcggacgggagggaacctaaaacgtcggaaccgttcgtaacggtcacgacccgaaaggcctccggtacccccgtcgg

SEQ ID NO: 323947 - DNA, 600 bp, Homo sapiens
  misc_feature: GZ8MTXP02GD6XG.4.39.D06.1.454.CMB.2.raw
  modified_base (318)..(318): a, c, t, g, unknown or other
  misc_feature (318)..(318): n is a, c, g, or t
  modified_base (485)..(485): a, c, t, g, unknown or other
  misc_feature (485)..(485): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactaggaaccagcaggtgacggttggtacgttaataactatgtctcctaggtaaccaaacaacacccaggacaaacgacccctaattcaattaattangagtcactagccggccctgacgggtcctagactcgtcttcctcgtcgacctaccgaaggcctaggccaaacgcccggtccctcccgtcgtaccgtctcgtcgggcctccgaggctggagagtcggaggtcttagtaactttattagttcgacacgtctactaatcgngacgtagacttaagtactagtgtagtacgtacggtacgggaacggaacggtaaacctacgtacgtaccgtacgtaaggacccgtacggaccgtacgtccgtacccgtccccgtcg

SEQ ID NO: 323948 - DNA, 574 bp, Homo sapiens
  misc_feature: GZ8MTXP02HTBDT.4.39.D06.1.454.CMB.2.raw
  modified_base (262)..(262): a, c, t, g, unknown or other
  misc_feature (262)..(262): n is a, c, g, or t
  modified_base (326)..(326): a, c, t, g, unknown or other
  misc_feature (326)..(326): n is a, c, g, or t
  modified_base (348)..(348): a, c, t, g, unknown or other
  misc_feature (348)..(348): n is a, c, g, or t
tcagagcactgtagcacgaccggtgctcgatttagtgacatctcgcagttctttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacgttgtcgttataactatgtctctgtaccaacaacaccagcaaagccccaattcataattangagtcactaagcgcctgagggtcctgatcgcttctctgcctcaaggctggcaacacggcctccngacctcctcgtggctccgagcngaggatgagctgattattatgcagctcgatatgacgagctaagttacaaagtgtagattagttcgggacggaacgggaaccaaacgtgacccggttacgtaaggtccaacgtacccgaaagggtccctaccgtcccccgtacggtcctaaccgttccgtccccgtttccccgccccttccccttccgtaacccgtcgggttaccgtcccttacgttcggaccgggg

SEQ ID NO: 323949 - DNA, 642 bp, Homo sapiens
  misc_feature: GZ8MTXP02JIFM6.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttatactatgtctcctggtaccaacacaccaggcaaacgccccaaatcataattatgagtcatagcggccctcgagggtccctgatgcttcctctcgcctccaaggtctggccaaacgaccggccctcccctgtacccgtctcgtcgggcctccgaggtctaggacggataggacggggtcttaggtactttaagtttaacgttcggtactaaacggtccttacgtaaagtttaactcggtacgaaggggtccttaaaggttaactaaagttggtacgttaagttacgtttaccggggacgggaaacgggtaaaccctaaaacgtaccgtaacccgttccgtaacggttaccgacggaaccccgtaacggtccctacccggcccccgtttaacccgg

SEQ ID NO: 323950 - DNA, 536 bp, Homo sapiens
  misc_feature: GZ8MTXP02FU1CR.4.39.D06.1.454.CMB.2.raw
  modified_base (302)..(302): a, c, t, g, unknown or other
  misc_feature (302)..(302): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcaacctccctccgcgtccggtctcctggacagtcagtcaccatctcctgcactggaaccagcagtgacgttggtcgttataactatgtctcctggtaccaacaacacccagcaaagcccccaaattcataattangagtcactaagcgccctcgaggggtccctgatcgcttctcctgcctcaaggctggcacacggccctccctgaccgtctctgggcctccgaggctgacggatgaggtatgattattattgcagctnatangcaggcagttacaatgtgattagttcgggacggacgggaaccaaacgtcggaacccgtccgtaaggtccacgacccgtaaaggccgtcgcccccttcgggtaccc

SEQ ID NO: 323951 - DNA, 681 bp, Homo sapiens
  misc_feature: GZ8MTXP02FMSVZ.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctgtaaccaacaacacccagacaaacgccccaaatcaataattatgagtcactaagccgccctcgacggggtccctgatccgtcttccctctcgccctaccgaaggtcctgggccaaaccgaccgggtcccttcccccgtggtaccccgttctcgtcgggggccttcccgaagggcctaggaacggtatgggaacgggtcttaggtaattttaactttagttcggactaaggtccttactaagttaatcggactaagggctaaaggtttaacaaagttggttagtaagtttagtttacgggggaacggggtaaacgggtaaacccgtaaaaccgttacggtaacccccggtttaccgtaaacggggttcccaaacgggtacccccgaaaagggtcccgtcccggtaccccccccgtttacggg

SEQ ID NO: 323952 - DNA, 604 bp, Homo sapiens
  misc_feature: GZ8MTXP02F5M1C.4.39.D06.1.454.CMB.2.raw
  modified_base (473)..(473): a, c, t, g, unknown or other
  misc_feature (473)..(473): n is a, c, g, or t
  modified_base (483)..(483): a, c, t, g, unknown or other
  misc_feature (483)..(483): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacgagggtcctgggcccagtctgccctgactcagcctccctccgcgtccgggtctcctggacagtcagtcaccatctcctgcactggaaccagcagtgtacgttggtcttaataactatgtctctgtaccaacaacaccagacaacgccccaatcatattatgagtacataagcgccctgacgggtcctgactcgtcttcctctcgcctacgaaggtctcgggccaaccgccggtaccctcccgtacgtacccgtctcggtcgggtcctacccggaggtccgtaggaagggtacgtcgggaggtctagtaactttattagttcgactagtactanagttagcganacggtactaaggtttaacaagttgtattaagttacggttacggggacgggaaaccgggtaaactaaacgtcgtaccgttacgaacgtacgaccgaccgaggtcctaccggtccccttacgg

SEQ ID NO: 323953 - DNA, 652 bp, Homo sapiens
  misc_feature: GZ8MTXP02JAY85.4.39.D06.1.454.CMB.2.raw
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtacgttataactatgtctcngtaccaacaacaccagacaacgccccaatcatattangagtcactagcgccctcgacgggtccctgactcgtcttcctctcgccctaccgaaggtctcggaccaaaccgacccggtcccttccccgtacggtacccgttccgttccggtcggggcccttacccggacgggtaccgttaggaacggggtaagttcgggaaacgggtccttaggtaaactttaagtttaagttcgacgtacgtctactagttaagtcggacgagggtactaggttaaacaagttgtagtacttacggttccgggacgggtaaacggaaccctaaacgtaccggtacccgttacgtaacggtacaccggtacccgaacggtccgtacccggtccccgtaccg

SEQ ID NO: 323954 - DNA, 592 bp, Homo sapiens
  misc_feature: GZ8MTXP02JB96C.4.39.D06.1.454.CMB.2.raw
  modified_base (227)..(227): a, c, t, g, unknown or other
  misc_feature (227)..(227): n is a, c, g, or t
  modified_base (304)..(304): a, c, t, g, unknown or other
  misc_feature (304)..(304): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaaccngcagtgacgttggtacgttataactatgtctcctgtaaccaacacaccaggacaaacgccccaaattcaatatttangagtcactagccgccctcgacgggtccctgactcgtcttcctctcgccctaccgaaggccttcggccaaacgccggtccctcccgtcgacccgtctccgcggggtcccttaccggacggcttggaggtactggacggtctagtatttatttagtcgcacgtctactagtatcgactaaggctaagtactaatgtaagtagttacgtcggacgggacggtaaaccctaacgtaccgacccgttacgtaaggtccaacgtacccgaaggtccgtacccgtccccgtccgg

SEQ ID NO: 323955 - DNA, 672 bp, Homo sapiens
  misc_feature: GZ8MTXP02JL482.4.39.D06.1.454.CMB.2.raw
  modified_base (309)..(309): a, c, t, g, unknown or other
  misc_feature (309)..(309): n is a, c, g, or t
  modified_base (337)..(337): a, c, t, g, unknown or other
  misc_feature (337)..(337): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtcccggtctccgtggacagtcagtccaccatcctcctgcacgtggaaccagcagtgtacgttggtacttataactatgtctcctagtaccaacaacacccaggacaaacgccccaatcataattngagtacatagccgccctgacgggtcccngatcgtctcctctcgacctacgacggctacggccaaccgccggcccttccctgtacccgtcgtcgtcgggtcctacccgaggtctggagtactgggaacgtcttagttattagtttacgtgaccgagttcctacgtaagttaccgtagtacggaacggtaccgttaaaggtttaacctaaaggtttcgtaaggttagtttacggggtaccggggaaccgggggttaaacggggaaaccccttaaaacggtccggggtaacccgttaccggttaaacggtccgtaaaccggtaccccggaaacgggtcccgtacccccggtcccccgtttaccggg

SEQ ID NO: 323956 - DNA, 608 bp, Homo sapiens
  misc_feature: GZ8MTXP02F7YEO.4.39.D06.1.454.CMB.2.raw
  modified_base (299)..(299): a, c, t, g, unknown or other
  misc_feature (299)..(299): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactatgtctctgtaccaacaacaccagacaaacgaccccaatcaataattangagtacactaagccgccctcgacggggtccctgatcgtcttcctctcgcctaccgaaggcctacggccaaaccgacccggtccctaccccgtcgtacccgtcgtccgtcgggccctcccgaggtcgtaggacggagttcggacggtcttagtaatttattacgttggactaagtcttacagttatcgacgaggtactaagttactaagtgtagtaattacggttacggacgggtaaacggaacctaaacgtcggaccgttaccgtaagtaccaacggacccgtaaggcccgtaccggtccccttaccgg

SEQ ID NO: 323957 - DNA, 624 bp, Homo sapiens
  misc_feature: GZ8MTXP02H4OSB.4.39.D06.1.454.CMB.2.raw
  modified_base (229)..(229): a, c, t, g, unknown or other
  misc_feature (229)..(229): n is a, c, g, or t
  modified_base (306)..(306): a, c, t, g, unknown or other
  misc_feature (306)..(306): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccngcagtgacgttggtcgttaataactatgtctcctggtaaccaacaacaccagacaaacgccccaattcataatttangagtcactaagcgccctcgacgggtcctgatcgtcttcctctcgcctacgaagctaggcaacgacggtccctccgtcgacccgtctcgtcgggtcctccgacggtctacggaggtaacttggacggtctagtatttagttagttgacagtctacattacgtagcgaggtcgtaagtttaaccaagttagtagtaagttacgtttaccggggacggaaaccggggtaaaaccaaaacggttccgtaaacccgttccgtaaacggggttaccaaaccggaccccgtaaacggtcccgttaccggaccccccgtttaccgg

SEQ ID NO: 323958 - DNA, 603 bp, Homo sapiens
  misc_feature: GZ8MTXP02F8XZC.4.39.D06.1.454.CMB.2.raw
  modified_base (304)..(304): a, c, t, g, unknown or other
  misc_feature (304)..(304): n is a, c, g, or t
  modified_base (452)..(452): a, c, t, g, unknown or other
  misc_feature (452)..(452): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacgagggtcctgggcccagtctgccctgactcagcctccctccggcgtccgggtctccgtggacagtcagtcacatcctcctgcactggaaccagcagtgacgttggtcttataactatgtctctgtaccaacaacaccagacaaacgaccccaatcaataattangagtacaacgtaagccgccctcgacgggtccctgactcgtcttcctctcgcctaccgtaaggctacggccaaaccgccgtccctcccgtcgtaccgtctcgtcgggcctaccgagctaggagactggacgtctagtattatttagtcnctacgctataagtatcgcgaggtaccttaaggtaactaagtaggtagtaagttacggtcggggacgggtaaacgggaaacctaaacgttcggaacccgtaccgtaaggtaccaaccggacccgaggtaccctacccggtccccgttaccgg

SEQ ID NO: 323959 - DNA, 658 bp, Homo sapiens
  misc_feature: GZ8MTXP02JHJHK.4.39.D06.1.454.CMB.2.raw
  modified_base (303)..(303): a, c, t, g, unknown or other
  misc_feature (303)..(303): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttaataactatgtctctggtaaccaacaacaccagacaaacgccccaaattcatattangagtcataagcgccctcgagggtccctagatccgtcttcctcgtcgccctaccgaaggcttcggaccaaccgaccggtcccttcccgacgacccgtcttaccgtcggggtccctccgaaggtccgtaggaacggtataggacggtcgttagtaaagtttatttaagttcgacgtaacggtccttaacaagttacgtcgacgacgggtactaagtttaaccaaagttggtaagtaacgtttacggtccgggaaacggggtaaacgggaaacccttaaacggtacccggtaacccgttaccgtaacgggtaccacgggtaccccgaaaggtcccgttcccggtaccccctttacggg

SEQ ID NO: 323960 - DNA, 707 bp, Homo sapiens
  misc_feature: GZ8MTXP02G0BP9.4.39.D06.1.454.CMB.2.raw
  modified_base (297)..(297): a, c, t, g, unknown or other
  misc_feature (297)..(297): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttgtcttataactatgtctctgtaccaacaacaccagcaaacgccccaaatcataattangagtcactaagcgccctcaggggtccctgatcgcttcctctgcctcagctggcaacacggcctcccgtgaccgtctcgtcgggccttcccgaggtctaggacgtagtggacggtacttaggtaactttatttaagtttacgccgtaacggtcctttaccaatttaagtcggaccgtaaaggggtaccctaaagggtttaaacctaaaagttcgggttaacggtaaagtttaaccgggtttaccgggggtaaccggggaaaacgggggttaaaccccctaaaaaccgggtttaccgggtaaacccccgggtttaaccggttaaacccgggggttaaccgaaacccgggttaaccccccggaaaacgggggttccccttacccgggttaccccccccggtttaccccggggg

SEQ ID NO: 323961 - DNA, 536 bp, Homo sapiens
  misc_feature: GZ8MTXP02G37SC.4.39.D06.1.454.CMB.2.raw
  modified_base (368)..(368): a, c, t, g, unknown or other
  misc_feature (368)..(368): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (429)..(430): a, c, t, g, unknown or other
  misc_feature (429)..(430): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (439)..(440): a, c, t, g, unknown or other
  misc_feature (439)..(440): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttaataactatgtctcctggtaccaaacaacacccagcaaaagccccaaaattcaataaattatagagtacaactaaagcggccctcaggggtccctgatcgcttcctctgcctccaaaggcngcaacacgacctcctcgtacgtctctcgcgcgacgcgngagagtgagntagtatattatannantanatannagagagtagtaataatagtagtatagtacggacggaacggaacgaaacgtacgacgtacgtaacgtacgacgacaacgaccgtaccgtcccgtccg

SEQ ID NO: 323962 - DNA, 631 bp, Homo sapiens
  misc_feature: GZ8MTXP02HBQJI.4.39.D06.1.454.CMB.2.raw
  modified_base (306)..(306): a, c, t, g, unknown or other
  misc_feature (306)..(306): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaaccaacaacacccagacaaacgccccaaatcattaattangagtcactaagccgccctcgaacgggtccctgatccgtcttccctctcgtcccctaccgtaaggctcgggccaaaccgaccgggtccctacccccgtcgacccgttcgtccgtcgggcctcccgtaggccgtggaggatcggaaggtcttagtatttagttattgaccagtctactatacgacgtggaacggtacttaaacggttaatagtcgtagtaaacgttacgggttacgggacgggtaaacggaaaccctaacggtaccgtaccggtaccggtaacgaccgtaccggacggtaaccgccgttccccggaccccgttccgg

SEQ ID NO: 323963 - DNA, 719 bp, Homo sapiens
  misc_feature: GZ8MTXP02G7UIV.4.39.D06.1.454.CMB.2.raw
  modified_base (309)..(309): a, c, t, g, unknown or other
  misc_feature (309)..(309): n is a, c, g, or t
  modified_base (339)..(339): a, c, t, g, unknown or other
  misc_feature (339)..(339): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaaccaccaggaccaaacgaccccaaattcaataattangagtcactaagccgccctcgacgggtcccngactcgcttcctctcgcctaccgaaggctcggacaaccgaccggtccctcccgtcgacccgtctccgtcgggcctcccgaggtcctaggacgggtagtgggacggtcgtaggttactttaagtttacgttcggtaccgtacggtccttaacgtagttaacgttcggaacggtacggggtaccttaaaggttaacctaaaggtttacggtagttaaaacggtttacggtttaccgggggaacggggtaaaaccgggtaaacccgtaaaaccggttacccggtaacccccgggtttaaccggttaacggggtacccgaaaacccggggttaacccccgaaaggggttcccccgttacccgggtacccccccggtttaccggg

SEQ ID NO: 323964 - DNA, 598 bp, Homo sapiens
  misc_feature: GZ8MTXP02JZ5GZ.4.39.D06.1.454.CMB.2.raw
  modified_base (306)..(306): a, c, t, g, unknown or other
  misc_feature (306)..(306): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgacgttggtcgttaataactatgtctcctggtaccaacaacacccaggcaaacgccccaaattcataatttangagtcactaagccgccctcgacgggtccctgatcgcttcctcctgccctcgaaggcctggccaacgaccggccctcccgtgacccgttctcgtcgggcctccgaggtcgtggacggatggacggtctgtatttaattagttgacagtctactattagtgacgaggactaagttacaagtgtagagttacgtcggggaccgggtaaacggggaaccctaaaacgtcggtaaccccgttacgtaacgggtacccacggtaccccgaaggtccctacccggcccccgtttaccgg

SEQ ID NO: 323965 - DNA, 683 bp, Homo sapiens
  misc_feature: GZ8MTXP02IRIJB.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctccctcaccctcctcactcagggcacagggtcctgggcccagtctgccctgactcagccctccctccgcgtcccgggtctcctggacagtcagtcaccatctcctgcactggaaccagcagtgtacgttggtcgttataactatgtctcctggtaccaacaaccaccaggaccaaacgcccccaaattcaataatttatgagtacactaagccgccctgacggggtccctgactcgtcttcctcgtcgccctacgaacggcttcggccaaaccgacccggtccccttacccccgtacggtaccccgttccgtcccgttccggggtcctccccgtaagggtcctagggtaagggtagttacggaacgggtccgttaaggtaatttacgtttaagttgtaccgtaacggtccttacgtattaagtcggaccgtaagggtcctaaagttactaaagtttggtagtagttacggttacggggacgggtaaaccggaaaccgtaacgttaccgaccccgtttacgtaaggcccgaacggaccccgaaaggtcccgttaccgcccccgtttacgg

SEQ ID NO: 323966 - DNA, 625 bp, Homo sapiens
  misc_feature: GZ8MTXP02G6P9G.4.39.D06.1.454.CMB.2.raw
  modified_base (308)..(308): a, c, t, g, unknown or other
  misc_feature (308)..(308): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactcggaaccagcagtgacgttggtcgttataactatgtctcctggtaccaacaacaccaggacaaacgccccaaattcataattangagtacactaagcgccctgacgggtccctgactcgtcttcctctcgcctccgaaggctggccaacgaccggccctcccgtcgacccgtctccgtcgggcctcccgaggcgtaggagggtatcgggtagtcttagtactttaagttacgttgactacgctactagtacgtgaaccgtaggtactaaggttaactaagtgtaagtaagttacggttacgggacgggtaaacgggaaccctaaacgttccgtaacccggttaccgttaaggtaccgaaccgaccccggtaaggtcccgtaccccggtaccccgttcccgg

SEQ ID NO: 323967 - DNA, 627 bp, Homo sapiens
  misc_feature: GZ8MTXP02JC87T.4.39.D06.1.454.CMB.2.raw
  modified_base (301)..(301): a, c, t, g, unknown or other
  misc_feature (301)..(301): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgtacgttggtcttataactatgtctcctgtaccaacaaccaccagacaaacgccccaatcataattangagtacagtagccggccctcgacgggtccctgactcgtcttcctctcgcctaccgaaggtctacggcctaaccgacccggtccccctccgtcgtacccgttccgttacgtccggggtcctcccgagggtcgtaggagggtactagggacggtcttagtactttattagttcgactacggttctacgtattagtcgcgtacggacttagtacgaagttgataacgttcgttacggggaccgggaaacggtaaacctaaccgtacgacccgttacgtaacgggtaccaacggtacccggaacgtcccgttacccggccccctttacgg

SEQ ID NO: 323968 - DNA, 647 bp, Homo sapiens
  misc_feature: GZ8MTXP02JADAT.4.39.D06.1.454.CMB.2.raw
  modified_base (319)..(319): a, c, t, g, unknown or other
  misc_feature (319)..(319): n is a, c, g, or t
  modified_base (538)..(538): a, c, t, g, unknown or other
  misc_feature (538)..(538): n is a, c, g, or t
  modified_base (647)..(647): a, c, t, g, unknown or other
  misc_feature (647)..(647): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggatagtcagtcaccatctcctgcactacggaaccagcagtgtacgttggtacgttaataactatcgtctcctaggtaaccaaacaacacccgaggaccaaacgaccccaattacataattangagtacaactacgcgtacccgtgacggggtccctgactcgtcttcctcgtcgccctacgaacggtccgtacggcctaaaccgcccgggtaccccttccccgtcgacccgttccttccggcgggtccttcccggaggtccgtaggaaggtacgtggtaacggtcttaagtaactttagtttacgtgaccgagttactacgtaattcgtacgacgacggtnttaaacggttactaagtgtagttatacgggtcggacggaaacgaaaccgtaacgtcgtaaccgtaccggtaagaccgacgaccccggtagcccgtaccgtcccccggtn

SEQ ID NO: 323969 - DNA, 609 bp, Homo sapiens
  misc_feature: GZ8MTXP02GG4SN.4.39.D06.1.454.CMB.2.raw
  modified_base (465)..(465): a, c, t, g, unknown or other
  misc_feature (465)..(465): n is a, c, g, or t
  modified_base (485)..(485): a, c, t, g, unknown or other
  misc_feature (485)..(485): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcactgaaccagcagtgacgttggtcttataactatgtctcctgtaaccaacaaccaccagacaaacgaccccaaattcaattaattatgagtcaactaagcgcctcgacgggtccctgatccgtcttccctctcgcctacgaagtcctcggcaacgaccggcccttaccctcgacctcgtcgtcgggtcctccgaggtctaggacggatcggagtctagtaattagtttattgcagtcttcaagttagngaccgaggtacctagttaanaagttgtagtaagttacggttacggggacggtaacgggaaaaccctaaacgtccggtaacccgttacgtaaccgggtaccaacggaccccggtaagtcccgtccccggtcccccgtttaaccgg

SEQ ID NO: 323970 - DNA, 551 bp, Homo sapiens
  misc_feature: GZ8MTXP02ITOIH.4.39.D06.1.454.CMB.2.raw
  modified_base (303)..(303): a, c, t, g, unknown or other
  misc_feature (303)..(303): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccttccctccgcgtccgggtctcctggacagtcagtcaccatctcctgcactggaaccagcagtgacgttggtcgttataactatgtctcctggtaccaacacacccaggcaaagccccaaatcataatttangagtcactaagcggccctcaggggtccctgatcgcttcctctcgcctccaaggctggcaacacggccctccctgaccgtctctcgggctccgagctgaggatggaggctagattattattgacagctcatatgacaggctagtttaacaatcgtagtatacgttcgggacggtaacgggaacctaaaaccgtcgaacccgttaccgtaagggtccacggacccgaaaggccgtaccgcccccgttcgg

SEQ ID NO: 323971 - DNA, 545 bp, Homo sapiens
  misc_feature: GZ8MTXP02F2URC.4.39.D06.1.454.CMB.2.raw
  modified_base (304)..(304): a, c, t, g, unknown or other
  misc_feature (304)..(304): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagacaaacgccccaaatcataatttangagtcactaagcggccctcgaggggtccctgatcgcttcctctcgcctccgaagctggcaacaccggcctccctgaccgtctcgtcgggctcccgaggctaggacggatggaggctagtattattattgcagtctacatatgcaggtctaagttacaatgtagattacgttcgggacggaacggaacctaaacgtcgacccgtacgtaagtcgaacgacccgaaggcctccgccccgttcg

SEQ ID NO: 323972 - DNA, 589 bp, Homo sapiens
  misc_feature: GZ8MTXP02GFF62.4.39.D06.1.454.CMB.2.raw
  modified_base (302)..(302): a, c, t, g, unknown or other
  misc_feature (302)..(302): n is a, c, g, or t
  modified_base (414)..(414): a, c, t, g, unknown or other
  misc_feature (414)..(414): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacaacaccagacaaacgccccaaatcataattangagtcatagccgcctcgagggtcctgatcgcttcctctcgcctcaaggctgcaccacggtcctccctgaccgtctcgtcgggctccgagctaggagactgagtctgtaattnttaattgctacgtctacattagcgtacgaggctaaagttactaagttagtagtacgttagttcgggggaacggtaaaccggggaacctaaaaccggttacggacccggtttaaccgtaagggttaccgaaaccggtacccgaaacgggtcccttccccggacccccgtttaccgg

SEQ ID NO: 323973 - DNA, 590 bp, Homo sapiens
  misc_feature: GZ8MTXP02HP6PW.4.39.D06.1.454.CMB.2.raw
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtcccgggtctcctggacagtcagtcaccatctcctgcacgtggaaccagcagtgacgttggtcgttataactatgtctcctgtaccaacaacaccagacaaacgccccaaatcataattatgagtacactaagccggccctgacgggtcctgactcgtcttccctctcgcctacaaggcctagggccaaccgaccggccctcccgtgacccgtctcgtcggggcctccgaggctggagatggagtctgtattattagttgcagtctanattgngacgaggtactaagttaataagttgagtagttacggttacggggacggtaaacgggaaccgtaaacgtcggtacccgttaccgtaacggtacgaaccggtcccgaaggtcccgtacccggccccgtttaccgg

SEQ ID NO: 323974 - DNA, 574 bp, Homo sapiens
  misc_feature: GZ8MTXP02HOVTK.4.39.D06.1.454.CMB.2.raw
  modified_base (300)..(300): a, c, t, g, unknown or other
  misc_feature (300)..(300): n is a, c, g, or t
  modified_base (445)..(445): a, c, t, g, unknown or other
  misc_feature (445)..(445): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttaataactatgtctctgtaccaacaacaccagcaaacgccccaaatcataattangagtcataagcgccctgacgggtccagtatcgcttcctctcgcctccagcctgcaactacggccctccgtcgaccgtctcgtcggctcccaggctcggagacgtggaggcttgtaatttacttagttcgactacgtctcgaaatntgacaagggtctaagttacaaatgtacgtagttacgttcgggacgggtaaacggaaaccctaaaacggtcgtaaacccgtcgttaaacggtcgaaccgacccgaaaggtccctccgtacccccgttcgg

SEQ ID NO: 323975 - DNA, 591 bp, Homo sapiens
  misc_feature: GZ8MTXP02H9X9S.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacaacaccaggacaaacgccccaaattcaataatttatgagtacactaagcggccctcgacgggtccctgactcgtcttccctctcgccctccaaggctggcaacgaccggtccctccctcgacccgtctccgtcggggcctcccgaggtcctggaggtacgtggacggtctagtatttattattgcagtctcatatcgacgaggctagtttaacaagttgtagtagttagttacggggacgggaacgggtaaacctaaaacgtcggtaacccgtaccgtaacggtcgaacggacccgtaacggcctcccggcccccgttccgg

SEQ ID NO: 323976 - DNA, 672 bp, Homo sapiens
  misc_feature: GZ8MTXP02FJXVU.4.39.D06.1.454.CMB.2.raw
  modified_base (303)..(303): a, c, t, g, unknown or other
  misc_feature (303)..(303): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttataactatgtctcctagtaaccaacaacacccaggacaaacgccccaaatcatattangagtcataagcgccctgagggtccctgatcgtcttcctctcgaccctaccgaaggccttagggccaaaccgaccggtccctcccccgtagtacccgtctccgtcggggccctccggtaggtcgtaggaaggtacgtggacggtacgttaggtaaatttagtttaaacgttcggactaacggtactaccttaagttaagtcgacgagggttacttaaacgttaacgaaatttcgggtagttaaagttacggttaccggggaccgggtaaacggggaaaccccctaaaagggttccgtaacccggttacggttaacggtaccaacccgggtacccgaaacggtcccgttacccggccccccgttaaccggg

SEQ ID NO: 323977 - DNA, 687 bp, Homo sapiens
  misc_feature: GZ8MTXP02GIPK6.4.39.D06.1.454.CMB.2.raw
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtccaccatcctcctgcactcggaaccagcagtgacgttggtacgttataactatgtctcctgtaccaacaacaccagacaaacgccccaaatcaataattangagtacactagcgccctcgacgggtcccngatccgtcttccctctcgccctcgaaggcctgggccaacgaccggtcccctacctcgaccgttctcgtacgggcctcccgaggtactggaaggtaatcggaagggtcttaggtaaattttagtttaaagttcgaccgtaagtccctactaacggtttaacgtacggacgtaacggtaacgttaaacggtttaacgtaagtttaggttaacgtaaaggtttacgggttaccgggggtaacgggtaaaaccggggtaaaccctaaaccggttacccggttacccggttaccggtaacggtaccgaacccggtaccggtaacccggtcccgttaccccggtacccccggtttacgg

SEQ ID NO: 323978 - DNA, 640 bp, Homo sapiens
  misc_feature: GZ8MTXP02FW1IR.4.39.D06.1.454.CMB.2.raw
  modified_base (293)..(293): a, c, t, g, unknown or other
  misc_feature (293)..(293): n is a, c, g, or t
  modified_base (476)..(476): a, c, t, g, unknown or other
  misc_feature (476)..(476): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttgtcgttataatatgtctcctggtacaacaacaccaggacaaacgaccccaaatntaactaaatttatgaggtacactaacgcggcccctcgaggggtccctgatccgctcccctctcgcctccgaaggccgttcgaccgaacaccgggcccttacccgtcgtaccgtcctctcgggtcctcccgacggcgtggacgggtaagtcggaggtacgtgtaattactttaattcgcgaacnctactagtaatcgacgagaccgtaagttacaaagtgtaggtaattacggtttacggggacgggaaacgggtaaacctaaaccggttaccgtaaccggttaccccgttaaggtaccgaaccgacccgtaaaaccggcgttaaccccgtcccccggtttaccccgg

SEQ ID NO: 323979 - DNA, 541 bp, Homo sapiens
  misc_feature: GZ8MTXP02FM2AG.4.39.D06.1.454.CMB.2.raw
  modified_base (304)..(304): a, c, t, g, unknown or other
  misc_feature (304)..(304): n is a, c, g, or t
  modified_base (423)..(423): a, c, t, g, unknown or other
  misc_feature (423)..(423): n is a, c, g, or t
  modified_base (436)..(436): a, c, t, g, unknown or other
  misc_feature (436)..(436): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacaacacccaggcaaagcccccaaattcataattatnagtcactaagcgccctcacggggtccctgatcgcttcctctgctccaaggctggcaacacggcctaccctgaccgtctctcgggctcccagctgaggatggaggctggtatattattgnagtctcaatatgnaggactagttacaaagtgtagtatagttcgggacggaaggggaacccaaacgtacggaccgtccgtaaggtacacgacccgaaaggtccgtcgcccccttaccgg

SEQ ID NO: 323980 - DNA, 609 bp, Homo sapiens
  misc_feature: GZ8MTXP02G02I8.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttgtcgttataactatgtctctgtaccaacaacacccagacaaacgccccaaattcataattatgagtacactaagcggccctcgacggggtccctgactcgtcttcctctcgccctaccgaaggtcctacgggccaaaccgaccggtccccttacccgtgacccgttcctcgtcggggcctacccgaggctaggacggtatggacggtcgtagtatttagtttattgacagtccttcattatcgacaggtactaaggttacaagttgagtacttaacggttcgggacgggtaacgggtaaaccctaacgttacgacccgttacgtaacggtacaaccggtacccgaacggcctcccggacccccgttacgg

SEQ ID NO: 323981 - DNA, 555 bp, Homo sapiens
  misc_feature: GZ8MTXP02JWJQO.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacaacacccaggcaaacgccccaaattcataatttatgagtcactaagcggccctcgagggtccctgatcgtcttcctctcgcctccaaggctggccaacgacggccctccctcgaccgtctcgtgggcctccgagctgagatggaggctagactttaattagttgctagctcatatgacaggctaagttacagtgtagtatacgttcggacgggtaacggaacctaacgtcgaacccgttacgtaacggtacacggtacccgaacggcctaccgtcccccgtaccgg

SEQ ID NO: 323982 - DNA, 633 bp, Homo sapiens
  misc_feature: GZ8MTXP02G7U1O.4.39.D06.1.454.CMB.2.raw
  modified_base (299)..(299): a, c, t, g, unknown or other
  misc_feature (299)..(299): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctcgtaccaacacaccagacaaacgccccaatcataattangagtcactacgcgccctcgacgggtccctagactcgtcttccctctcgcctaccgaacggctcgggccaaccgaccggacccttcccgtcgtacccgtctccgtcgggcctaccgaggctggacgtagtcggaggtctagtaactttattagttcgactacgtctacgaattacgtgacgtacggtactaacggtttacaaagttggttagtaaaacgttacggttaccggggaacgggtaaacggaaaccccgtaaaaggtacccgtacccggtttaacgtaacggtacaacccgggacccgtaaaggcccctttccggacccccgtttccgg

SEQ ID NO: 323983 - DNA, 618 bp, Homo sapiens
  misc_feature: GZ8MTXP02IMFU9.4.39.D06.1.454.CMB.2.raw
  modified_base (301)..(301): a, c, t, g, unknown or other
  misc_feature (301)..(301): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccaccatctcctgcactggaaccagcaggtgtacgttggtcttataactatgtctctgtaccaacacaccaggacaacgccccaatcataattngagtacataagcgccctgacgggtccctgactcgtcttcctctcgcctacgaaggccgtcgcctaaacaccggtccctcccgtcgacccgtctcgtcgggcctaccgaggcgtacggaggtagtggaggtcgttgtaactttattagttcggactacggtctacctagttaatcgacgagggtactaaggtttacaaagttggtacgtaagttacgttacggggacgggtaaaccgggaaccgtaaacgttccggaacccggttcgtaagggtacccaacggtaccccgaacggtcccgtacccgcccccgttacgg

SEQ ID NO: 323984 - DNA, 543 bp, Homo sapiens
  misc_feature: GZ8MTXP02H45AE.4.39.D06.1.454.CMB.2.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctctgtaccaanaacaccagacaaacnccccaaatcataattangagtcataagcgccctgagggtccctgatcgcttcctctgcctacaaggctagacaaccgaccggccctccctcgacccgtctccgtcgggcctcccgaggctggacgatggagctagatttattattgacagtctcgtatactgcaggtctaagttacagtgtatatacgttcggacggaaaggacccaaacgtcgacccgtacgtaaggtacacggacccgtaagcctccgcccccgttcg

SEQ ID NO: 323985 - DNA, 652 bp, Homo sapiens
  misc_feature: GZ8MTXP02GB2C0.4.39.D06.1.454.CMB.2.raw
  modified_base (301)..(301): a, c, t, g, unknown or other
  misc_feature (301)..(301): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctgtaccaacaacaccagacaacgaccccaatcatattangagtcactagccgccctcgacgggtcctgactcgtcttcctcgtcgcctccgaaggtcctacgggccaaaccgccggtccctacccgtcgtacccgttctccgtcgggcctccgaggtcgtaggaggtatggaacgtctagtatttacgttattcggactacgtctactaagttagtcggaccgtaaggtaccgtaaagtttaacgtaaagtggttagtaagtttacggtaccgggggaaccggggtaaacgggtaaccctaaaacggtcccggtaaacccggttccggtaaacgggtaccgtaaccggaccccggtaaggtccccgttaaccccgcccccggtttaccgg

SEQ ID NO: 323986 - DNA, 700 bp, Homo sapiens
  misc_feature: GZ8MTXP02J0BQ8.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcacgccctccctccgcgtccggtctcctggacagtcagtcaccatctcctgcactggaaccagcagtgtacgttggtacgttataactatgtctctagtaaccaacaaccacccgaggaccaaacgaccccaattcaattaaatttatagagtacaactaacgccggccctcggacggggtccctgactcgtcttcctctcgccctaccgaaggccttacggccaaaccgacccggtccctacccgtacgtacccgttcctccggtcgggtccctccgacggcgttaggaggtagtaggacggtcgttagttaatttaacgtttagttacggccgtaagtccctttagtaactttaacgtcggtaccgtaacgggtaaccgttaaggtttaaacctaaaggtttggtaaggttaacgttacgggttacgggggacgggtaaaccggaaaccctaacgtaccggtaccccgttacggtaacggtacccgaacggaccccgtaacggtcccgttccccggtccccgttacccgg

SEQ ID NO: 323987 - DNA, 551 bp, Homo sapiens
  misc_feature: GZ8MTXP02GAHH1.4.39.D06.1.454.CMB.2.raw
  modified_base (303)..(303): a, c, t, g, unknown or other
  misc_feature (303)..(303): n is a, c, g, or t
  modified_base (419)..(419): a, c, t, g, unknown or other
  misc_feature (419)..(419): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctggtaccaacaacaccaggacaaacgccccaaatcataatttangagtcataagcgccctgacggggtccctgatcgcttcctctcgcctcaagctcggcaacacggcctcccgtcgaccgtctcgtcggctccgagctgagatgagctgattattatgnagtctacgatatgcaggctaagttactaagtgtagtaacgttacgttcgggacggtaacgggaacctaaaacgtcggtacccgtcgtaaggtaccgacgacccgtaacggtcctccggcccccgtttaccgg

SEQ ID NO: 323988 - DNA, 651 bp, Homo sapiens
  misc_feature: GZ8MTXP02JXHL1.4.39.D06.1.454.CMB.2.raw
  modified_base (303)..(303): a, c, t, g, unknown or other
  misc_feature (303)..(303): n is a, c, g, or t
  modified_base (330)..(330): a, c, t, g, unknown or other
  misc_feature (330)..(330): n is a, c, g, or t
  modified_base (385)..(385): a, c, t, g, unknown or other
  misc_feature (385)..(385): n is a, c, g, or t
  modified_base (507)..(507): a, c, t, g, unknown or other
  misc_feature (507)..(507): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctggtaccaacaacacccaggacaaacgccccaaatcatattangagtcactaagcgcctcgacgggtccngatcgtcttcctctcgcctaccgaaggtcctcgggccaaacgccggtccctccgngtacccgtctccgtcgggcctacccgagggccttaggacgtatggaacggtccttaggtaactttattacgttcggacctaagtcttacaagttagcgaccgtagggacctaacgtttaaanaagttcgtaagtaagttacggttcggggaacgggtaaacgggtaaaccctaaaaacggtccggaaacccggtttccgtaacgggttaccgaaaccggtaccccgaaaacggggtccccttaacccgggtccccccgtttaacgg

SEQ ID NO: 323989 - DNA, 637 bp, Homo sapiens
  misc_feature: GZ8MTXP02JLO70.4.39.D06.1.454.CMB.2.raw
  modified_base (303)..(303): a, c, t, g, unknown or other
  misc_feature (303)..(303): n is a, c, g, or t
  modified_base (332)..(332): a, c, t, g, unknown or other
  misc_feature (332)..(332): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgacgttggtcgttataactatgtctctgtaccaacaaccaccagacaaacgccccaaattcatattangagtcactagccgccctcgacgggtcccngactcgtcttcctctcgccctacgaaggctcgggaccaaacgacccggtcccttaccccgtaggtacccgttcgtccgtcggggtccctacccgaggtcctagggaacggtagtcggacggtcttaggtaatttactttagttcgacgtacgtacttactaattagcgaccgtagggtacttaaacgtttaacgaaagtttgtaaggtaaattcgggttacgggacggtaaacgggaaacctaacgtacggtacccgtacgtaacggaccacggtacccgaaggtccctcccggtaccccttcgg

SEQ ID NO: 323990 - DNA, 558 bp, Homo sapiens
  misc_feature: GZ8MTXP02FX3R2.4.39.D06.1.454.CMB.2.raw
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgacgttgtacgttataactatgtctctgtaaccaacacaccagacaacgcccaatnatattngagtcatagcgccctgacgggtccngatcgtcttccnctcgcctcagctgcacncgcctccngaccgtctcgtgctcgagtctgagtancggagtcgttagtatttacttagtgacagtccttatagttagacgngtacggtactaagttacaagttgtactaagttacggtcgggaacggtaacggaaaccgtaaccgtacggtacccgtacgtaacggtacgaccggtacccgacgtccgtaccggtaccccgtaccgg

SEQ ID NO: 323991 - DNA, 581 bp, Homo sapiens
  misc_feature: GZ8MTXP02JANO8.4.39.D06.1.454.CMB.2.raw
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
  modified_base (346)..(346): a, c, t, g, unknown or other
  misc_feature (346)..(346): n is a, c, g, or t
  modified_base (487)..(487): a, c, t, g, unknown or other
  misc_feature (487)..(487): n is a, c, g, or t
tcagagcactgtagcacgaccggtgctcgatttagtgacatctcgcagttctttgggttttggggggaagtgtggtacggcctggggggtccctgagactctcctgtacagcctctggattctcctttgatgattatggcatgagctgggtccgccaagctccgagggaaggggctggagtgggtgtctggtatgaattggagtggcggtagtacagcttatgcagactctgtgaaggccattcaccatctcagagacaacgccaagaactccctgtatctgcaattgaacngtctgagngccgagacncggtcttgtattacngtgcgaagaactagtttagggntgtagtggtaacagtctgcttattccgtcgtacgttgggtttagacttacgtggagccgaggggacgtcccgtggtcctaccgtctccctcacgccctaccgaacccgacgggcccctagttcccggttcccttcccccgnggcccgtccctgacctccgaaggcgccaccctccggaagacgccaaccgcggccggcccgtcgggctcggccgtacggtaccaaacggttaccc

SEQ ID NO: 323992 - DNA, 559 bp, Homo sapiens
  misc_feature: GZ8MTXP02HYF74.4.39.D06.1.454.CMB.2.raw
  modified_base (300)..(300): a, c, t, g, unknown or other
  misc_feature (300)..(300): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccaccatctcctgcactggaaccagcagtgacgttggtcgttataactatgtctctgtaccaacacaccagacaaacgccccaatcatattangagtcatagcgcctgacgggtcctgactcgcttcctctcgcctacaggtctggcaacaccggcctccctgaccgtctcgtggcctcgagctgagtatggagctgtattatattgntagtcctntagttangacgagtactaagttaacgtagtgtagtacgttacggtacgggacggtaacgggtaaacctaacgtaccgtaccgttacgtaacggtaccgaaccggtacccgaacgtcccgtacccgtacccccgtcg

SEQ ID NO: 323993 - DNA, 547 bp, Homo sapiens
  misc_feature: GZ8MTXP02F1W0L.4.39.D06.1.454.CMB.2.raw
  modified_base (453)..(453): a, c, t, g, unknown or other
  misc_feature (453)..(453): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttaataactatgtctcctggtaccaacaacacccaggacaaacgaccccaaatcaataattatgagtcactaagcgccctcacgggtccctgatcgcttcctctcgcctccaaggctggcaaacacggccctaccctcgaccgtctcgtggcctccgagctgagatgagctgtatattattgcagtctacatagtgcaggtcaagttaanaatgtagtacttagtacggacggaacggaacctaacgtacgaccgttacgtaacgtacgaacggacccgaacgtccgtacccggtaccccgtcg

SEQ ID NO: 323994 - DNA, 624 bp, Homo sapiens
  misc_feature: GZ8MTXP02HXGNY.4.39.D06.1.454.CMB.2.raw
  modified_base (227)..(227): a, c, t, g, unknown or other
  misc_feature (227)..(227): n is a, c, g, or t
  modified_base (339)..(339): a, c, t, g, unknown or other
  misc_feature (339)..(339): n is a, c, g, or t
  modified_base (393)..(393): a, c, t, g, unknown or other
  misc_feature (393)..(393): n is a, c, g, or t
  modified_base (416)..(416): a, c, t, g, unknown or other
  misc_feature (416)..(416): n is a, c, g, or t
  modified_base (481)..(481): a, c, t, g, unknown or other
  misc_feature (481)..(481): n is a, c, g, or t
tcagagcactgtagcacgaccggtgctcgatttagtgacatctcgcagttctttggggggggtctcaggaggcagcgctctcaggacgtcaccaccatggcctgggctctgctcctcctaaccctcctcactcaggcacagggtcctgggcccagtctgccctgactcagcctccctccgcgtccggtctcctggacagtcagtcaccatctcctgcactggaaccngcagtgtacgtttggtcgttaataactatcgtctccgtgtaccaacaaccacccagacaaaccgcccctaaatcaattaattatgagtacactaagcgcctcgacgggtccngactcgcttctcctcgcctacgagctggacacgccgtcctccctcgtaccgtcncgtcgggcctcgaggctggacgngtgacgtcttagatttattgtagcctaagcttacaattgtcgacgtacggtacttaacggttaanagttggtacgtaagtttacggttaccggggaaacgggtaaacggggaaaacccttaaacggttaccgaacccggttacgttaacggccgtaaacggaccccggtaaacgtcccggtaaccccgtacccccgtttcggtacccc

SEQ ID NO: 323995 - DNA, 591 bp, Homo sapiens
  misc_feature: GZ8MTXP02JVCHG.4.39.D06.1.454.CMB.2.raw
  modified_base (230)..(230): a, c, t, g, unknown or other
  misc_feature (230)..(230): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
  modified_base (400)..(400): a, c, t, g, unknown or other
  misc_feature (400)..(400): n is a, c, g, or t
tcagagcactgtagcacgaccggtgctcgatttagtgacatctcgcagttctttggggggggtctcaggaggcagcgctctcaggacgtcaccaccatggcctgggctctgctccctcctcaccctcctcactcagggcacagggtcctgggcccagtctgccctgactcagcctccctccgcgtccgggtctcctggacagtcagtcaccatctcctgcactggaaccngcagtgacgttgtcgttatactatgtctctgtaccaacacaccagacaacgcccaatcatattngagnactagcgccctgacgggtcctgatcgtcttccnctcgtccctacgaagcncggtccaaaccgtccggcccctcccgtacgcccgtctcgtcgggcctaccgnggtactggacgtatggagtactagtatttaagttagttgacctaggtcctagtattacgtgacgaggtctaaacggttataaagtggtagtaattacgggttcgggaaaccgggtacggaaacctaaaacgtcgtaacccgtacgtaacgccgtaacggacccgtacggccttcccggaccccgttcccgg

SEQ ID NO: 323996 - DNA, 590 bp, Homo sapiens
  misc_feature: GZ8MTXP02HLNUU.4.39.D06.1.454.CMB.2.raw
  modified_base (425)..(425): a, c, t, g, unknown or other
  misc_feature (425)..(425): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctcctccgcgtccggtctcctggacagtcagtccacatctcctgcactggaaccagcagtgacgttggtcgttaataactatgtcctctaggtaccaaacaacacccagacaaacgaccccaaattcaattaattatagagtacaataagccggccctagacgggtccctgactcgtcttcctctcgcctaccaaggcctggaccaaacgtaccggccctcccgtacgacccgtctcggtcggcctacccggngtacgtaggagtgtgagtacgtagtattattagttagtacgtacgtactactatagtacgacgagtacgtagtaataagtagtagtacgtacgtacggacggaacggaaccgaacgtacgtaccgtacgtaacgacgacgaccgacgaccgtccgtacccgtccg

SEQ ID NO: 323997 - DNA, 563 bp, Homo sapiens
  misc_feature: GZ8MTXP02I1YEA.4.39.D06.1.454.CMB.2.raw
  modified_base (228)..(228): a, c, t, g, unknown or other
  misc_feature (228)..(228): n is a, c, g, or t
  modified_base (296)..(296): a, c, t, g, unknown or other
  misc_feature (296)..(296): n is a, c, g, or t
  modified_base (365)..(365): a, c, t, g, unknown or other
  misc_feature (365)..(365): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtacttataactatgtctctgtaccaacacaccagacaacgccccaatcatattangagtcataagcgccctgacgggtccctgactcgtcttcctactcgcctacaaggtcctcggccaaaccnccggccctccctcggacctctcgtcgggcctccgaggctagacgtatggaggtctaggtattagttagtgcagtctacattagcgcgaggtctaagttacagttgtgtaatacggttcggacggtaacggaaccaaaacgtcgaacccgttacgtaacggccaacgaccccgaagtccttacccgcccccgtttacgg

SEQ ID NO: 323998 - DNA, 591 bp, Homo sapiens
  misc_feature: GZ8MTXP02FKX3M.4.39.D06.1.454.CMB.2.raw
  modified_base (305)..(305): a, c, t, g, unknown or other
  misc_feature (305)..(305): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacaacacccaggacaaacgccccaaattcataattangaggtcactaagcggccctcgacggggtccctgatcgcttcctctgcctcaaggctggcaacgacgcctccctcgaccgtctcgtcgggctcccgaggctggagatggaggtctgtattattatgacagctacatatcgcacggactaagttaacaagtttggtagtaaagttacgtttacggggacgggtaaacgggtaaacccaaaacgttcggaccccgttaccgtaagggtaccaaaccggtacccccgtaaaggccccgtcccggaccccccgtttaccgg

SEQ ID NO: 323999 - DNA, 564 bp, Homo sapiens
  misc_feature: GZ8MTXP02FFDFQ.4.39.D06.1.454.CMB.2.raw
  modified_base (301)..(301): a, c, t, g, unknown or other
  misc_feature (301)..(301): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacaacacccagcaaacgccccaaatcatattangagtcactagcgccctcacggggtccctgatcgtctcctctgctcgaaggctggccaaccacggccctcccgtgaccgtctctagggccttccgaggctggacggatgaggtctgtaaatttattattggactagctacagtatgaccagggcctaaggttaacaagtgtagtaagttagttcgggacggacgggaaccaaaacgttcgaaccgttacgtaacggtacaacggacccgaacgggcctccggacccccgttcgg

SEQ ID NO: 324000 - DNA, 634 bp, Homo sapiens
  misc_feature: GZ8MTXP02JK689.4.39.D06.1.454.CMB.2.raw
  modified_base (229)..(229): a, c, t, g, unknown or other
  misc_feature (229)..(229): n is a, c, g, or t
  modified_base (297)..(297): a, c, t, g, unknown or other
  misc_feature (297)..(297): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtcttataactatgtctctgtaccaacaacaccagacaacgccccaatcatattangagtcatagcgccctgacgggtccctgactcgtcttcctctcgccctaccgaaggtcctagggaccaaccgaccggtccctacccgtgacccgttctccgtcgggtcctacccgaggccgtaggaggtacgtcggaacggtcgtagttaactttaagttattcggactagtcctactagttatcggacgaggtactaaggtttaaccaagttggtagtaactttaggtaccggggacgggtaaacggggaaccctaaaacggtccggtaaccccggttacgtaacggggtacctaaccgggacccgaacggtcccgtacccggtacccccgttccgg

SEQ ID NO: 324001 - DNA, 776 bp, Homo sapiens
  misc_feature: GZ8MTXP02HRD29.4.39.D06.1.454.CMB.2.raw
  modified_base (327)..(327): a, c, t, g, unknown or other
  misc_feature (327)..(327): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcacgccctccctccggcgtccgggtctccgtggacagtcagtcaccatcctcctgcactggaaccagcagtgtacgttggtacgtttaataactatcgtctcctacggtaaccaaacaaccaccaggacaaaccgacccctaaattcaattaaatttanagtaacggtacactaaacggccgtaccctcgtacggggtcccctagactccgctttcccctctcgtccctaccgaaggtcctacgggacccaaaccgaccggtcccccttaccccgtacgggtaccccgttccgtcccgggtcggtacccgttaccggacgggtccgttagggaacgggtagttacgggaaacggttccgttaaggttaacttttagttaaaccgtttgaccgtaacgttcccttacgttaacgttaagttcgaccgtaaggggtacccttaaagttaaccgtaaagttggttaacgtaaaggttttaccgggttaccggggaaccgggtaaacggggtaaaaccccctaaacggttcccggtaaacccggttacggtaaccggtaccaaaccgggtaccccgaaagggtccccttacccggtccccccggtttaccgg

SEQ ID NO: 324002 - DNA, 618 bp, Homo sapiens
  misc_feature: GZ8MTXP02JR7HA.4.39.D06.1.454.CMB.2.raw
  modified_base (300)..(300): a, c, t, g, unknown or other
  misc_feature (300)..(300): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctgtaccaacaacaccagacaaacgccccaatcatattangagtcactagcgccctcgacgggtccctgatcgtcttcctctcgcctacgaaggctggccaacgacggtccctccgtacgaccgtctcgtgggcctccgagctaggagacgtgacggtctagtatttaattagttcggactagtcctataattagtcgacgacgggtacctaaggttaaccaaagttcggtagtaaacgttacggttaccggggacgggaaacgggtaaaccctaaaacgtccggtaacccgttaccgtaacggtaccgaaccggtaccccggaaacggtcccggtacccgtacccccggtttaccgg

SEQ ID NO: 324003 - DNA, 658 bp, Homo sapiens
  misc_feature: GZ8MTXP02HI206.4.39.D06.1.454.CMB.2.raw
  modified_base (257)..(257): a, c, t, g, unknown or other
  misc_feature (257)..(257): n is a, c, g, or t
  modified_base (302)..(302): a, c, t, g, unknown or other
  misc_feature (302)..(302): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacgagggtcctgggcccagtctgccctgactcagccctccctccgcgtccggtctcctggacagtcagtcaccatctcctgcactggaaccagctagtgtacgttggtacttaataactntgtctcgtgtaccaacaacaccagacaacgccccaatcataattnagagtacactagcgtccctcgacgggtcctgactcgtcttcctctcgccctacgaacgctcggccaaaccgccggtccctcccgtacgtacccgtcttccggcgggtaccctacccggaggtccgtaggaggtagtcggaacgggtcttaggtaatttagtttaagttcggactacgttccttacgagttacgacgtacgtaacggtaccttaaaggtttaacaagttgtaagttacgttaccgggttacggggaccgggaaacgggtaaaccctaaaacggtccggtaacccgttaccggtaacggtaccgaaccgacccggtaacggtcccggtaccccgtacccccgttccgg

SEQ ID NO: 324004 - DNA, 594 bp, Homo sapiens
  misc_feature: GZ8MTXP02GUBUW.4.39.D06.1.454.CMB.2.raw
  modified_base (300)..(300): a, c, t, g, unknown or other
  misc_feature (300)..(300): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctctgtacaacaacaccagacaaacgccccaaatcaataattangagtacactaagccgccctgacgggtccctgactcgtcttcctctcgccctcgaaggctcggccaacgacggccctccgtcgacccgtctcgtcgggctccgagtcgtacggagagtgacgtcgtagtatttattagttgacgtagtcttactagttagcgtacgacggtactaacggttaactaagttgtagttaagtacggtttacgggacgggtaaacgggaacctaaaacgtccggtaaccgttacgaacgtacgacgtacccgaacggtcctaccggtcccccgtacgg

SEQ ID NO: 324005 - DNA, 662 bp, Homo sapiens
  misc_feature: GZ8MTXP02G1MJ1.4.39.D06.1.454.CMB.2.raw
  modified_base (299)..(299): a, c, t, g, unknown or other
  misc_feature (299)..(299): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctcctgtaccaacaacaccagacaacgccccaatcataattangagtcataagcgccctcgacgggtccctgactcgtcttcccgtctcgcctccgaacggcttacgggcctaaaccgacccgggtcccttaccccgtgtacccgttccgttccgtcggggccttcccgaggtcctggacggatgggagtcgttaggtatttaattaagttcgacgtagtccttacgtattacgcgagtacggtactaaacgtttacaagttgtaacgtaacgtttacggttacggggaccggggtaaaccgggtaaacctaaaccgttaccggaaccccggtttaccggtaaaggttaccccgtaaccggaccccgtaaacgggcccgttaaccccggtccccccggtttaccgg

SEQ ID NO: 324006 - DNA, 544 bp, Homo sapiens
  misc_feature: GZ8MTXP02JQZFY.4.39.D06.1.454.CMB.2.raw
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
tcagagcactgtagcacgaccggtgctcgatttagtgacatctcgcagttctttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgccccaaattcataattangagtcataagcggcctnagggtccctgatcgcttctctgcctcaaggctggcaacacggcctccctgaccgtctcgtcgggctccgagctgagatgaggctgattattatgcagctanatngacagactagtactagtgtagtatagtcggacggacggaacaacgtcgaccgtacgacggcacgacccgagccgtccgccccgtacgtcctaccgtcctacccgttaccccacccttaacctaccctaacgtacgtcgtcctcgtacggtacgg

SEQ ID NO: 324007 - DNA, 581 bp, Homo sapiens
  misc_feature: GZ8MTXP02JH64U.4.39.D06.1.454.CMB.2.raw
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (367)..(367): a, c, t, g, unknown or other
  misc_feature (367)..(367): n is a, c, g, or t
  modified_base (454)..(454): a, c, t, g, unknown or other
  misc_feature (454)..(454): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctctgtaccaacaacaccagacaaacnccccaaattcataattangagtacactaagccgtccctcgacgggtccctgactcgcttcctctcgcctcaaggctggcaacnccggcctccctgacccgtctcgtgggcctcccgaggtcctaggacggtatcggaggtctaggtaatttatttagttgacagtcctanattagtcgacgaaggtcctaaaggttaacaagttggtagtacgttacgttcgggacgggtaaacggactaaacgtcggaccgtacgtaaggtacacggtacccgaaggtcctaccggccccgttacg

SEQ ID NO: 324008 - DNA, 650 bp, Homo sapiens
  misc_feature: GZ8MTXP02HZVJI.4.39.D06.1.454.CMB.2.raw
  modified_base (420)..(420): a, c, t, g, unknown or other
  misc_feature (420)..(420): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctcctgcactacggaaccagcagtgtacgttggtcgttataactatgtctctcgtacaacacaccaggacaaacgaccccaatcaataatttatgagtacactaagcgccctcgagggtccctgactcgtcttcctctcgccctaccaaggcctaggccaaacgaccggcccttcccctcggtacccgtcgtcctcggggtcctacccgngggtacctggacggtaagtggaaggctaggtatttacgtttaaagtttcgaccgaaggttctaccgtaattacttacgccgaagggtcctaaaggttttaaccaaagttggttaaccgtaagtttaacggtttccggggacggggaaacgggtaaacccgtaaaacgtcggtaacccgtcggtaaggtaccgacgtacccgaaacggtccttcggtaccccccgttccgg

SEQ ID NO: 324009 - DNA, 671 bp, Homo sapiens
  misc_feature: GZ8MTXP02JDRPM.4.39.D06.1.454.CMB.2.raw
  modified_base (317)..(317): a, c, t, g, unknown or other
  misc_feature (317)..(317): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggaaccagcagtgtacgttggtacgttaataactatcgtctcgtaggtaccaaacaaccaccaggaccaaacgaccccaaattcaataatttangacggtacacgtaacgccggaccctcggacgggtccctagtactcgtccttccgtctccgccctacgaaggtccgtaggccaaacgccggtcccctccctacgtacccgttcctcggtcgggccctaccgaggtacgtacggaaggtatcgggacggtcttaaggtattttagtttacgttcgacgtaacgtccttatagttacgtcggacgtacgggtacttaaacgtaactaaagttggtaagtaacttacgggttccggggaacggaacggggtaaaaccctaacgtaccgggtaccgttaccgtaaggtaccgacgtaccccggaaggtccccgtccgtacccccgttcg

SEQ ID NO: 324010 - DNA, 648 bp, Homo sapiens
  misc_feature: GZ8MTXP02IX6NV.4.39.D06.1.454.CMB.2.raw
  modified_base (301)..(301): a, c, t, g, unknown or other
  misc_feature (301)..(301): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctcctccgcgtccgggtctctggacagtcagtcaccatcctctgcactggaaccagctagtgtacgttggtcgttataactatgtctctgtaccaacacaccagacaaacgccccaaatcaatattangacgtacacgtaagccgtccctgacgggtccctagactcgtcttccgtctcgccctaccgaaggtccgtagccaaccgaccggtccctcccgtcggaccgtctcgtacgggcctccgaggtcgtggaagtacgtggaagtcgtagtaactttagttagttacggactaaggtccttactagtacgtcggacgtaggtacttaaaggttactaaagtgtaacgttaagttacggttaccgggacggggtaaaccgtaaaccgtaaaccgttcggtaacccggttacggtaacggttaccgaaccggttacccgaaggtcccccgttacccggtacccccgtttaccgg

SEQ ID NO: 324011 - DNA, 640 bp, Homo sapiens
  misc_feature: GZ8MTXP02HN2WS.4.39.D06.1.454.CMB.2.raw
  modified_base (227)..(227): a, c, t, g, unknown or other
  misc_feature (227)..(227): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcaggcacagggtcctgggcccagtctgccctgactcagccctccctccgcgtccggtctcctggacagtcagtcaccatctcctgcactggaaccngctagtgacgttggtacgttataactatgtctctgtaccaacacaccagacaacncccaatnataattnagagtacanagcgccctcgaggtcctgtatcgtcttcctctcgcctacgaggcctaggccaaaccgaccggtccctcccccgtacggtaccccgttcgtcccggtcggggtccctcccggtaggtccgttagggacggtagtgggacggtcttagtaagtttatttacgttggtacctaggttctacgtatagtcgaccgtaggtactagttaactaagtgttaacgtagttaacggttccgggtacgggaaaccggtaaaccgtaaacgtaccggtacccgttacggttaacggtacccgaacgacccggaacggtcccgtaccccgtacccccgtttcccgg

SEQ ID NO: 324012 - DNA, 554 bp, Homo sapiens
  misc_feature: GZ8MTXP02I0QH0.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctcctggtaccaacaacacccaggacaaagccccaaatcataatttatgagtcactaagccggccctcgagggtccctgatcgcttcctctgcctcaagctgcacacggcctaccctgaccgtctctgggctccgagctggagatgagctagattattattcgacagtctacattagtgcaggctaaaggttactaaagtgtgtaactagttcggggacggtaaacgggaacctaaacgtaccgtaccgttaccgtaagggtccaacgcccgaaaggccttccgacccccgtttccgg

SEQ ID NO: 324013 - DNA, 606 bp, Homo sapiens
  misc_feature: GZ8MTXP02JA88V.4.39.D06.1.454.CMB.2.raw
  modified_base (309)..(309): a, c, t, g, unknown or other
  misc_feature (309)..(309): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtacgttataactatgtctcctggtaccaaacaacacccaggacaaacgaccccaaatcaataattangagtcactaagccgtccctcgacgggtccctgactcgtcttcctctcgccctaccgaaggtcctcggccaaccgaccggtccctcccgtgacccgtctcgtcgggcctaccgaggctaggagagtggacggtcttagtactttattagttcgacgtacgtctactagttagtcgacgtacggactaagttacaagttgtagtattacggttcggggacggtaaacggaacctaaacgtacggtacccgtacgtaaggtaccaacggtacccgaaggtcctacccgtccccgttacgg

SEQ ID NO: 324014 - DNA, 700 bp, Homo sapiens
  misc_feature: GZ8MTXP02GL7BE.4.39.D06.1.454.CMB.2.raw
  modified_base (248)..(248): a, c, t, g, unknown or other
  misc_feature (248)..(248): n is a, c, g, or t
  modified_base (294)..(294): a, c, t, g, unknown or other
  misc_feature (294)..(294): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctccgtggacagtcagtcaccatctcctgcactggaaccagcagtgacgttggtcttanactatgtctctgaccaacacaccagacaacgccccaatcataattngagtcatagcgccctgacgggtccctgactcgtcttcctctcgccctacgaagggctacgggaccaaccgtacccgggtcccttaccccgtcgtaccccgttcctccggtcggggcctacccggaggtcctaggaacggtagtacggaacgggtcttaggtactttaagtttaagttcggactaacgtcttactaagttaagtcggacgtaacgggtactaaacggtttaaaactaaggttcgttaaaggttaacggtttaaccggggttaccgggggaaaccgggtaaaaccgggtaaaacccctaaaccgggttaacccggtaacccggttaaccggtaaccgggtaacccgaacccgggtaaccccgtaaccgggtccccgtaccccggtacccccgttccgg

SEQ ID NO: 324015 - DNA, 658 bp, Homo sapiens
  misc_feature: GZ8MTXP02I5GJA.4.39.D06.1.454.CMB.2.raw
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggaaccngcagtgacgttggtcgttataactatgtctcctacgtaccaacaaccaccagaccaaacgccccaaatcataattangagtacactaagcgccctgacgggtccctagactcgtcttcctctcgcctaccgaagccttaggccaacgaccggtccctcccgtgaccccgtcgtaccgtcgggtcctacccgaggtcgtaggaggtagttcggaacgggtcttaggtaattttaacgttagttacgacctagtccttactaagttagtcggacgtagggtacctaagttaaccaaagttggttagtaagtaggttccggggacggggtaaaccgggtaaaccctaaaacggtccggtaacccgttaccggttaacggtaccgaaccggtacccgtaaacggtcccgttacccggtccccccgtttacgg

SEQ ID NO: 324016 - DNA, 692 bp, Homo sapiens
  misc_feature: GZ8MTXP02FPU73.4.39.D06.1.454.CMB.2.raw
  modified_base (308)..(308): a, c, t, g, unknown or other
  misc_feature (308)..(308): n is a, c, g, or t
  modified_base (336)..(336): a, c, t, g, unknown or other
  misc_feature (336)..(336): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactacggaaccagcagtgtacgttggtacttaataactatgtctcctgtaaccaacaaccaccagacaaacgccccaaattcaatattangagtcaactagccgccctgacgggtccngatcgtcttcctctcgcctaccgaggtcgtcgaccaacgaccggtccctcccgtacgtaccgttcgtcggtcgggtccctccggacggtcgtaggaacggtagcgggtaacggtcgttagttaatttacgtttaagttccgacgttacgtaccttacgtaaagttcgtaccggtacgtacgggtaaccttaaaggtttaacgtaaaaggttggttaacgttaagtttaacgggttaccggggaaacggggttaaaccgggaaaacccgtaaacgttaccggtaacccggttacgtaacgggttaccgaaccggtaccccggtaacggtccccgtacccggtacccccgtttaccgg

SEQ ID NO: 324017 - DNA, 523 bp, Homo sapiens
  misc_feature: GZ8MTXP02FMV20.4.39.D06.1.454.CMB.2.raw
  modified_base (366)..(366): a, c, t, g, unknown or other
  misc_feature (366)..(366): n is a, c, g, or t
tcagagcactgtagcacgaccggtgctcgatttagtgacatctcgcagttctttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtcctctgggctccaggctgngatgaggctgatttattattgcagctcatatgcaggcagttacaatgtgatagttcgggcggagggaccaaactgaccgtcctaggtcagcccaaggcctacgccccctcggtcactcctcgttccccgcccctcctcctacacgtgtctctgacgg

SEQ ID NO: 324018 - DNA, 562 bp, Homo sapiens
  misc_feature: GZ8MTXP02GO439.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgccccaaattcataatttatgagtcataagcgccctcgagggtccctgatcgcttcctctcgcctcaaggctggcaacgacggcctccctgaccgtctctgggcctccgagctgagatgaggctgattattattgcgtagctacatatgacaggctaagttacaagtgtatagttagttcggacgggaaacgggtaaccaaaacgtcgaacccggttccgtaacgggttaccgacggaccccgtaaagggccttacccggtacccccgtttcccgg

SEQ ID NO: 324019 - DNA, 558 bp, Homo sapiens
  misc_feature: GZ8MTXP02HP28T.4.39.D06.1.454.CMB.2.raw
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (384)..(384): a, c, t, g, unknown or other
  misc_feature (384)..(384): n is a, c, g, or t
  modified_base (396)..(396): a, c, t, g, unknown or other
  misc_feature (396)..(396): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccngcagtgacgttggtcgttaataactntgtctctgtaccaacacaccagacaacgccccaaatcatattatgagtcactagcgccctcgacggtcctgactcgtcttcctctcgcctacgagctacggccaacgaccgcctccctcgacctctcgnggtctccgagcngagagtgagtctagtattattagttcgctacgtctactatatcgacaggtactaggttacaagttgtagtacttacggttcggacggtaacggaacctaacgaccgtaccgtacgtaacggaccgaacgtacccgaacgtcccgtaccgtccccgttaccgg

SEQ ID NO: 324020 - DNA, 606 bp, Homo sapiens
  misc_feature: GZ8MTXP02JKJFH.4.39.D06.1.454.CMB.2.raw
  modified_base (301)..(301): a, c, t, g, unknown or other
  misc_feature (301)..(301): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccaccatcctcctgcactggaaccagcagtgacgttggtacttataactatgtctctgtaccaacacaccagacaacgcccaaatcaatattangagtacatagcgccctgcgggtcctgactcgtcttcctctcgcctaccgaggcctcggaccaaccgtacccggcccttcccgtcgacccgtccgtcgtcgggtcctacccgaggtccgtggaggagtcggaaggtcgttagtaacttttagttaacgttcgacgtacgtacttcgtaagtacgtccgagacggtaattaagtactaagtgtagtagttacggttacggggaacggtacggaaacctaaggtaccgtaccgtacgtaaggccgaacgaccgtacgccttcccggacccctttacgg

SEQ ID NO: 324021 - DNA, 513 bp, Homo sapiens
  misc_feature: GZ8MTXP02GWWSF.4.39.D06.1.454.CMB.2.raw
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (421)..(422): a, c, t, g, unknown or other
  misc_feature (421)..(422): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttaataactatgtctcctggtaccaaacaacacccaggcaaaagcccccaaatcataaatttangagtcataagcgccctnaggggtccctgatcgcttccnctgctaccaaggcaggcaaacacggcctaccctgacctctctgggctccaggctagagagngagntntatatatnnantanatanagnaganatatatagatatagtgacggacggaacgaaacgtacgacgacgtaacgtacgacgaccgacgacgcgcccgtccg

SEQ ID NO: 324022 - DNA, 541 bp, Homo sapiens
  misc_feature: GZ8MTXP02FWTD7.4.39.D06.1.454.CMB.2.raw
  modified_base (301)..(301): a, c, t, g, unknown or other
  misc_feature (301)..(301): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagcaaacgccccaatcataattangagtcactaagcgccctcgacggggtccctgatcgcttcctctcgcctccaaggctggccaaccgaccggccctcccgtgaccgtctcgtcgggctccgaggctgagatgaggctgtattattattgcagctacgatatgcgaggctaagttacaagtgtagattagttcgggacggaacggaaccaaacgtcgacccgtaccgtaaggtcacgacccgaaggcctaccggccccctcgg

SEQ ID NO: 324023 - DNA, 665 bp, Homo sapiens
  misc_feature: GZ8MTXP02G8JWL.4.39.D06.1.454.CMB.2.raw
  modified_base (301)..(301): a, c, t, g, unknown or other
  misc_feature (301)..(301): n is a, c, g, or t
  modified_base (504)..(504): a, c, t, g, unknown or other
  misc_feature (504)..(504): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggaaccagcagtgtacggttggtcgttaataactatgtctctgtaccaacacaccagacaacgcccaatcataattangagtcatagcgccctgacgggtccctgactcgtcttccctctcgccctaccgaaggtcctacggccaaaccgtacccgggtcccccttacccgtaccggtaccccgttcttaccggtcggggcccttacccgaagggtccgtaggaggtatcggaggtccttaggtactttagttagttcggactagtcctactaagttacgngaccgtaggacctaaggttaactagttgtaggtaattacgggttaccggggaccgggtaaacgggtaaaccctaaacggttacccggtacccggtttaccgttaacggtaccgaacccgggtacccgtacggtacccgtaccccggtcccccgtttaccgg

SEQ ID NO: 324024 - DNA, 609 bp, Homo sapiens
  misc_feature: GZ8MTXP02FODPJ.4.39.D06.1.454.CMB.2.raw
tcagagcactgtagcacgaccggtgctcgatttagtgacatctcgcagtttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcttataactatgtctcctgtaccaacaacacccaggacaaacgccccaaattcataattatgagtcataagcgaccctcgacgggtcctgatcgcttcctctgcctaccaaggctcggccaaaccaccggtccctccccgtagacccgtctcgtcggggcctcccgaggtctggaggatggaggtctgtaatttattacttgacagtctacattaacgtgacgaggacctaaggttaacaagtgtaagtacgttacggttccgggacggggaaacgggtaacccaaaacgttcggtaacccgttaccgttaacgggtacgaccggtaccccgaacggtaccccgttaccggaccccccgtttccgg

SEQ ID NO: 324025 - DNA, 642 bp, Homo sapiens
  misc_feature: GZ8MTXP02GVM0W.4.39.D06.1.454.CMB.2.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (376)..(376): a, c, t, g, unknown or other
  misc_feature (376)..(376): n is a, c, g, or t
  modified_base (426)..(426): a, c, t, g, unknown or other
  misc_feature (426)..(426): n is a, c, g, or t
  modified_base (503)..(503): a, c, t, g, unknown or other
  misc_feature (503)..(503): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctcctccgcgtccggtctcctggacagtcagtcacntctcctgcactggaaccngcagtgacgttggtacgttataactatgtctccgtagtaaccaaacaaccacccgaaggaccaaaaccgaccccctaaaatttcctaattaaatttagtagacgtacaacgtaagccggccctacggacggggttccctgtactccgtnttcccctctcgccctacgaggtcctcggaccaacgacccggtcctcccgngtacccgtctcggtcgggccttcccggagtcgtacggaggtacgtaggacggtctagttaatttaacgtttgtacgngtacgtctactaagtagtgcctaagggccttaaagtaactaagtgtaatacggttacgtcgggaccggaaacggtaacctaaacgtcggaaccgtacgtaacgacgaccgaaccggacgtcctacccggaccccgttcg

SEQ ID NO: 324026 - DNA, 642 bp, Homo sapiens
  misc_feature: GZ8MTXP02JAWFL.4.39.D06.1.454.CMB.2.raw
  modified_base (184)..(184): a, c, t, g, unknown or other
  misc_feature (184)..(184): n is a, c, g, or t
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (306)..(306): a, c, t, g, unknown or other
  misc_feature (306)..(306): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
tcagagcactgtagcacgaccggtgctcgatttagtgacatctcgcagttctttgggttttgggggaagtgtggtacggcctggggggtccctgagactctcctgtacagcctctggattctcctttgatgattatggcatgagctgggtccgccaagctccgagggaagggctggagtgggtntctggtatgaattggagtggcggtagtacagcttatgcagactntgtgaaggcatcaccntctcaganacacgcaaagactcctgtatcngactaattgaacngtcngagacgccgaggacncggtcctttagtacttacgtgtgccgtaagtaacgtagttttaggggnttagtaggtgtaaaccgngtcgtgtacttacgttcgtacgtacggtttgggttacgacgttcgggcgggaccgacgggcgtcccgtcggtccctcccgtcctccgtccgaccgtaccctacccgaaccgtaccggtcccgtacgttccccggtccccttccccgcggcccgtcccgtacgtccgtaccgacggccgtacccgtacccgtaccggacgacgaccgtaccggccggcccggtccggtcggtcgtccggtaccgtacggtaccgaacgttacccttacccg

SEQ ID NO: 324027 - DNA, 765 bp, Homo sapiens
  misc_feature: GZ8MTXP02GR4QB.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcgagggcacgagggtcctgggcccagtctgccctgactcacgccctccctccgccgtccgggtctccgtggacagtcagtccacctactcctcctgccacgtaggaaccagcaggtgtacggttggttacgttataactatcgtctccgttacgaaccaaacaaccacccgaggaccaaaccgacccctaaattactaattaaatttagacggtaggtaccaacgtaaacggtcccggaccctacggacggggttcccctaggtacctccgttccttcccgtcgtcctacccgtaccgaggtccgtacggacctaaacccgaccggtccccttcccgtaccgtacccgtcgttccggtccggggtccctacccggaggtccgtaggacggtagtggacggttacgttagttaaagtttagtttagtaccggtatacgttacgtactagtaacgttcgacgtacggaacgttaaacgtttacgtaaggtagtttacgtaaaacggtttcggtaaccggggaacggggttaaacggtaaaaccccgtacggtaccgttaaccccgggtacgttaaccgggtaccgaaaccggtacccgggttaacgccccgttccggtacccccgtttaacccgg

SEQ ID NO: 324028 - DNA, 616 bp, Homo sapiens
  misc_feature: GZ8MTXP02GWW1M.4.39.D06.1.454.CMB.2.raw
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
  modified_base (344)..(344): a, c, t, g, unknown or other
  misc_feature (344)..(344): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcacgcctccctccgcgtccgggtctcctggacagtcagtcaccatctcctgcactggaaccagcagtgacgttggtcgttataactatgtctcctgtaccaacaacaccagacaacgccccaaatcataattangagtcatagcgccctcgacgggtccngatcgtcttcctctcnctcaagctaggcaacgaccggtcctcccgtcgaccgttctccggtcgggcctaccgacggccttggaaggtagtaggacggtcttaggtaatttattaaagtttgacgtacgtactactaattacgtcgacgtaacgggtaccttaaaggttaactaaagttcggtagttaacgttacggttaccgggacggggtaaacgaaacccgtaaacgtcggtaccccgtagtaacggtacgtacggaccaacggtcctaccggcccccgttaccgg

SEQ ID NO: 324029 - DNA, 665 bp, Homo sapiens
  misc_feature: GZ8MTXP02HWV4O.4.39.D06.1.454.CMB.2.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtcgttataatatgtctctgtaccaaacaacaccagacaaacgaccccaatcaataattanagagtacactaacgcgccctcgacgggtccctgactcgtcttcctctcgtccctaccgaacggtccttacggcctaaaccgaccgggtccccttacccgtacgtaccccgttctcccgtgggaccctcccgagggtcctaggaaggtagtcggtaggtcgttagtattttaattagtttcggactacggttctacgtaattagtcgacgacgggtacctaaaggtttaaaccgaaagttggtacgtaagttagtttccggggacgggtaacggggtaaaccctaaaacgtaccggtaacccggttcgttaaacggtccgtaacggtacccgaacggtacccgttccggacccccgtttaccgg

SEQ ID NO: 324030 - DNA, 672 bp, Homo sapiens
  misc_feature: GZ8MTXP02HANRG.4.39.D06.1.454.CMB.2.raw
  modified_base (256)..(256): a, c, t, g, unknown or other
  misc_feature (256)..(256): n is a, c, g, or t
  modified_base (305)..(305): a, c, t, g, unknown or other
  misc_feature (305)..(305): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactaggaaccagcagtgtacgttggtacttataactntgtctctagtaaccaacaacaccagacaaacgccccaaatcaataattngagtacatagccgccctgacgggtccctgactcgtctcctctcgcctacgagctcggaccaaccgaccggccctcccgtgacccgtcgtcgtcgggcctaccgaggtctaggagtagtcggaaggtctaggtaatttagttagtcgtacacgtcctacgtagttaagtcggacgtaacggtacgtaaagttaaccgtaaagtttcggaagtttaacgttacgggttaccgggggaaaccggggtaaaacgggaaacccctaaaacgggttacccggaaaccccggtttaaccggttaacgggtacccgaaacccggttaaccccggaaacggtccccgttaaccccggggtcccccctttaaccggg

SEQ ID NO: 324031 - DNA, 589 bp, Homo sapiens
  misc_feature: GZ8MTXP02JGN8Z.4.39.D06.1.454.CMB.2.raw
  modified_base (306)..(306): a, c, t, g, unknown or other
  misc_feature (306)..(306): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctggtaccaacaacacccaggacaaacgaccccaaatcataattangagtcatagcgccctcgacgggtcctgatcgcttcctctcgcctacgaggtctggccaaccgaccgggtccctaccccgtcgacccgttctcgtcggggtccctcccgaggtctcggaggtatcggaggtctgtatttattagttcgcagtctacatagtgcaggtactagttaacgaagtgtagtatacgttcgggacggtaacgggaacctaaacgtcggacccgttaccgtaaggtaccgaacggacccgaaggtcccgtcccggtacccccgttaccgg

SEQ ID NO: 324032 - DNA, 673 bp, Homo sapiens
  misc_feature: GZ8MTXP02H3H1L.4.39.D06.1.454.CMB.2.raw
  modified_base (319)..(319): a, c, t, g, unknown or other
  misc_feature (319)..(319): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctctcactcaggcacaggtcctgggcccagtctgccctgactcacgccctccctcggccgtccggtctcctggacagtcagtcaccatctcctgcactggaaccagcagtgtacgttggtcgttaataactatcgtctcgtacggtaaccaaacaaccacccgaggacaaaccgacccctaaattcaattaatttangagtacaacgtaagccgtcctacgacgggtcctagactcgtcttccctctcgtccctacgaacggtcgtcggaccaaccgtaccggtccctacccgtacgacccgtctcgcgggtaccctccggacggtcgtacggaggtagtacgggacggtacgttaaggttactttaaagttcgtttacgacgtaacgttctactagttacgtggtaacgtacggtacttaaacgttaacgtaaagttggtaacgtagttacgggttcggggacggtaaacggtaaccgaaacgtcggtaaccccgtcgtaacggtaccgaaccggtacccgaacggtcccggtacccgtcccccgtacgg

SEQ ID NO: 324033 - DNA, 596 bp, Homo sapiens
  misc_feature: GZ8MTXP02GGELN.4.39.D06.1.454.CMB.2.raw
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccggcgtccgggtctccgtggacagtcagtcaccatcctcctgcactggaaccagcagtgacgttggtcttaataactatgtctctgtaccaacacaccagacaacgacccaaatcaataattangagtcatagcgccctcgacgggtccctgactcgtcttcctctcncctacgaagctgccaaccgaccggccctccctcgaccgtctcgtcggcctccgaggctaggagatggaggtctagtaatttagttagttgactacgtctacgtaatagtcgacgtacggtactaacggttaacaaagttgtaagtaagttacgggttacgggacgggtaaacggaacctaaacgtacgtaacccgtaccgtaacggaccgaacggacccgaacggtccgtacccggtccccttaccggg

SEQ ID NO: 324034 - DNA, 557 bp, Homo sapiens
  misc_feature: GZ8MTXP02FUR7B.4.39.D06.1.454.CMB.2.raw
  modified_base (329)..(329): a, c, t, g, unknown or other
  misc_feature (329)..(329): n is a, c, g, or t
  modified_base (340)..(341): a, c, t, g, unknown or other
  misc_feature (340)..(341): n is a, c, g, or t
tcagagcactgtagcacgaccggtgctcgatttagtgacatctcgcagttctttgggaggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttgtacgttataactatgtctctgtaccaacaacaccagacaacgaccccaattcaataattatgagtcactagcgccctcgacggtcctnactctctctcnncctacacgctgcaacgacgccctcctgaccgtctcgtggcctcgagctgagatgagctagtatttattattgcagtctactatagtgactaggtactaggttacaaagttggtacgtagttcgttaccgggacgggtaaacggtaaaccgtaaacgtccggtaaaccgtccggtaacggtaccaccggtaccgaacggtccgtacccggtcccccg

SEQ ID NO: 324035 - DNA, 625 bp, Homo sapiens
  misc_feature: GZ8MTXP02H1MMW.4.39.D06.1.454.CMB.2.raw
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctctcactcagggcacagggttctgggcccagtctgccctgactcagccctccctccgcgtccggtctcctggacagtcagtcaccatctcctgcactggaaccagcagtgtacgttggtcgttataactatgtctctgtaacaacaacaccagcaaacgccccaatnataattangagtacataagcgcctcgagggtcctgactcgcttcctctcgtccctacgtaacggccttgggcctaaaccgcccggtccccctaccccgtagtaccccgtctcccgtcggggcctacccgagggcctaggacggtatcggaaggtctaggtactttattagttcgactagtctacatatcggacgtagggtctaaggttaactagtagtagtaattacgggttcggggaacggacgggtaaaccctaaaacgtccgtaacccggtccgttaacgggtacccacggtaccccgaaggggtccccttaccggtccccccgtttacgg

SEQ ID NO: 324036 - DNA, 540 bp, Homo sapiens
  misc_feature: GZ8MTXP02HSSP3.4.39.D06.1.454.CMB.2.raw
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (430)..(433): a, c, t, g, unknown or other
  misc_feature (430)..(433): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
tcagagcactgtagcacgaccggtgctcgatttagtgacatctcggcagttctttggggggggtctcaggaggcagcgctctcaggacgtcaccaccatggcctgggctctgctcctcctcaccctcctcactcgagggcacagggtcctgggcccagtctgccctgactcagccctcccgtcccggcgtccgggtctccgtggacagttcagtcaccatcctctgcactggaaccagctagtgacgtttggtacgttaataactatgtctctggtaacaacaacacccagcaaacgccccaaattcatattatgagtcactaagcgccctgacgggtcctgatcgacttccntcgcctaccaggcctggccaacncggcctcccgtgccgtctcacgggctcgaggcagagtgngngtgtgtatatatnnnntnanangngagtagtagtagtagtagtagtagtagtacggacggacggaacgaacgtacgtaccgtacgtaacgtacgacgaccgaccgtaccgtccgtcccgtccg

SEQ ID NO: 324037 - DNA, 663 bp, Homo sapiens
  misc_feature: GZ8MTXP02HDPFS.4.39.D06.1.454.CMB.2.raw
  modified_base (303)..(303): a, c, t, g, unknown or other
  misc_feature (303)..(303): n is a, c, g, or t
  modified_base (490)..(490): a, c, t, g, unknown or other
  misc_feature (490)..(490): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcttataactatgtctctggtaccaacaacaccagacaaacgccccaaattcataattangagtcactagcgtccctgacgggtcctgactcgtcttcctcgtcgtcctccgaaggtcgtacgccaaaccgtcggccccttccccgtagtcccgtcgtaccgtgggtccctccgacggtctacggagtactgggacggtactaggttatttaagtttagttcgaccgtaacgtcttaccgtaagttntacggaccgtaaggtaccgttaaaggtttaacccgtaaagtgggttacggtaaacgtttacggttaccgggggaacggggtaaacggaaacccgtaaaacgttccgtaacccggttacgtaacggtaccgaaaccgtacccggaacggtcccgtaccggtacccccgttccgg

SEQ ID NO: 324038 - DNA, 723 bp, Homo sapiens
  misc_feature: GZ8MTXP02JL1E1.4.39.D06.1.454.CMB.2.raw
  modified_base (389)..(389): a, c, t, g, unknown or other
  misc_feature (389)..(389): n is a, c, g, or t
  modified_base (584)..(584): a, c, t, g, unknown or other
  misc_feature (584)..(584): n is a, c, g, or t
tcagagcactgtagcacgaccggtgctcgatttagtgacatctcgcagttctttgggttttggggggaagtgtggtacggcctggggggtccctgagactctcctgtacagcctctggattctcctttgatgattatggcatgagctgggtccgccaagctccgaggggaagggctgggagtgggtgtctggtatgaattggagtggcggtagtacagtcttatgcagtactcgtggtaggaacgggcctattccacctatcctaccagacgaacaacggccaaagacctccctagtactcgtagactaagttcgaaactgtctaggagacgccgaaggaccgcggtctttagtattacgtggtagacgaagtaacttaggtttagggngtagttaggtacggtaaacagtctgtacttacggtttccgacggttacgtttggggtttacgaccgttacggtcggaggcccggaggggtacccgtcccggttggtacccgtacccgttcctcctaccgaaccgtcccctaacccggaaccggtaaccggggcccctacgggttccccgttcccgttcccccggngggtcccctcccgttcgcccgtaccgaacggtccacccgtacccggaccggaggaaccgcccgaaaccggccgggtccccggggtcccggtggggtcccgtccgggtaccgtacggggtaaccgtaaaccggtttcccc

SEQ ID NO: 324039 - DNA, 620 bp, Homo sapiens
  misc_feature: GZ8MTXP02F38CK.4.39.D06.1.454.CMB.2.raw
  modified_base (307)..(307): a, c, t, g, unknown or other
  misc_feature (307)..(307): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgacgttggtcgttataactatgtctctggtaccaacaacacccaggacaaacgcccccaaattcataatttangagtcataagcggccctcgacggggtccctgactcgtcttcctctcgcctaccaaggcctggccaaaccgaccggaccctcccctcgacccgtctccgtggggccttacccgaggctggagtataggacggcttagaatttagttaagtttcgctaggtcttacgtaattagtacgaccgtaagggtctaaaggtttaacaagtttggtagtaagttacggtttacgggacgggtaaacgggaacctaaaacgtcgtacccgttaccgttaaggaccaacggacccgaagtccgtcccgaccccgtttaccgg

SEQ ID NO: 324040 - DNA, 608 bp, Homo sapiens
  misc_feature: GZ8MTXP02FJUCW.4.39.D06.1.454.CMB.2.raw
  modified_base (281)..(281): a, c, t, g, unknown or other
  misc_feature (281)..(281): n is a, c, g, or t
  modified_base (412)..(412): a, c, t, g, unknown or other
  misc_feature (412)..(412): n is a, c, g, or t
  modified_base (454)..(454): a, c, t, g, unknown or other
  misc_feature (454)..(454): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgtaccaacaacaccagcaaacnccccaaatcataattatgagtcactaagcgccctcgaggggtccctgatcgtcttcctctgccctaccaaggcctggccaaaccaccggccctacccgtcgaccgtctcgtcgggctccgagctggagtanggaggctagtaattacttagttcgacacggtcttacaattanagacacgggactaaagttactaaagtgtacgtaagttagttaccggggacggggtaaacgggtaaacccaaaacgttcggaaacccgttccggtaaacggtacccgaaacggaccccgtaaacggggtccttacccggccccccgtttaaccgg

SEQ ID NO: 324041 - DNA, 646 bp, Homo sapiens
  misc_feature: GZ8MTXP02I9DQF.4.39.D06.1.454.CMB.2.raw
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (394)..(394): a, c, t, g, unknown or other
  misc_feature (394)..(394): n is a, c, g, or t
  modified_base (413)..(413): a, c, t, g, unknown or other
  misc_feature (413)..(413): n is a, c, g, or t
  modified_base (454)..(454): a, c, t, g, unknown or other
  misc_feature (454)..(454): n is a, c, g, or t
  modified_base (506)..(506): a, c, t, g, unknown or other
  misc_feature (506)..(506): n is a, c, g, or t
  modified_base (539)..(539): a, c, t, g, unknown or other
  misc_feature (539)..(539): n is a, c, g, or t
tcagagcactgtagcacgaccggtgctcgatttagtgacatctcgcagttctttgggttttggggggaagtgtggtacggcctggggggtccctgagactctcctgtacagcctctggattctcctttgatgattatggcatgagctgggtccgccaagctccaggggaaggggctggagtgggtgtctggtatgaattggagtggcggtagtacagtcttatgcagacttctggtaggaagggccgtattccacctatcctaccgagagaccaacgcccaaagaaccctccctagtactctgactaaattgaaacngtcngagacgccggaagacgacggtcctttagtatactgtgacgaagtaactagtttaggggttagtaggtgaaacngtcgtgtactagtttccgngttacggttgggttcaccgtggcggggaccgaggggtaccncccgtgtcccacccgtctccgtacaccgccctacccaaccgacgggtccccncgttacccgggtccccttcccccgcggtccccncccgtcggcctacggacgaccgacccgtacccgcggaacaccgaccgaccgccggtcccgccggtcggcgtccgtcggtaccggacgtaacggtacctttaaccccg

SEQ ID NO: 324042 - DNA, 608 bp, Homo sapiens
  misc_feature: GZ8MTXP02HS570.4.39.D06.1.454.CMB.2.raw
  modified_base (426)..(426): a, c, t, g, unknown or other
  misc_feature (426)..(426): n is a, c, g, or t
  modified_base (486)..(486): a, c, t, g, unknown or other
  misc_feature (486)..(486): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtcccgggtctcctggacagtcagtcaccatcctcctgcactggaaccagcagtgtacgttggtacgttaataactatcgtctcctaggtaaccaaacaaccacccagacaaacgccccaaatcataattatgagtacactaagccgccctgacgggtcctgactcgtcttccctctcgcctaccgaggctgctaaccaccggtcctcccgtcgaccgtctcgtcggtcctcgagctggagtntaggaggtctagtattattattgactagtctataatagtcgacgaggtactaggttaaanatggttataagttacgggtttacgggacggtaaacgggtaaaccctaaacgtaccggtaacccgtacggttaacgaccgaaccgtaccccggaaaggtcccgtacccgtcccccgttaccgg

SEQ ID NO: 324043 - DNA, 562 bp, Homo sapiens
  misc_feature: GZ8MTXP02FJX79.4.39.D06.1.454.CMB.2.raw
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacaacacccagacaaacgccccaaatcataattatgagtcactaagcggccctcgaggggtccctgatcgcttcctctgcctccaaggctggcaacgaccggtcctccctgacccgtctcgtcggccttccgacggctcggaggatggaaggtcttaggtacttaagtttattgacagccttcaattagtgacgtaggcgtaagttacaaagtgtataagtagttcgggacggagggaacctaaaacgttcgaccgtacgtaagtccgacgacccgaggcctcgacccccgttcg

SEQ ID NO: 324044 - DNA, 623 bp, Homo sapiens
  misc_feature: GZ8MTXP02IKH5W.4.39.D06.1.454.CMB.2.raw
  modified_base (300)..(300): a, c, t, g, unknown or other
  misc_feature (300)..(300): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtcccgggtctcctggacagtcagtcaccatcctcctgcactggaaccagcagtgacgttggtcgttataactatgtctctgtaccaacacaccagacaacgccccaaatcatattangagtcactaagccgccctcgacgggtccctgatcgcttcctctgccctcgaagctcggcaacgaccggtccctccctcgaccgtctcgtcgggctccgagctgacgtatcgaggtctagtatttattagttcgactagtccttcgtattaacgtcgacgtagggtactaacggttaactaaagttgtaagtaacgtttaggtttcggggaaccggggtaaacggggtaaaccctaaaccggttacggtaacccgttaccgtaacggttacccgaaccggtacccgaaaacggggtccctacccgggaccccccgtttaccggg

SEQ ID NO: 324045 - DNA, 647 bp, Homo sapiens
  misc_feature: GZ8MTXP02IOA63.4.39.D06.1.454.CMB.2.raw
  modified_base (229)..(229): a, c, t, g, unknown or other
  misc_feature (229)..(229): n is a, c, g, or t
  modified_base (314)..(314): a, c, t, g, unknown or other
  misc_feature (314)..(314): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggaccagtcagtcaccatctcctgcactgaaccngcagtgtacgttggtacgttaataactatcgtctccgtgtaaccaaacaacacccaggacaaacgaccccaaattcataatttanagagtacataagccgccctgacggggtccctgtactccgtcttccctctcgtcccttacgaacggtcctacggacccaaacgacccggtccctcccgtacgtacccgtcttccgtgggccctcgacggcgtggacggtgtaggaggtctagtactttaattgttcgacgagttcctatatacgtcgacgaggtactaaggttaactaagtgtaagttagttacggttccgggacggtaaacgggaaaccctaaaacgtccggtaacccggttacgtaacgggttaccaaacggtaccccgtaaaggtcccgttaacccgtcccccgtttacgg

SEQ ID NO: 324046 - DNA, 608 bp, Homo sapiens
  misc_feature: GZ8MTXP02JLFCQ.4.39.D06.1.454.CMB.2.raw
  modified_base (262)..(262): a, c, t, g, unknown or other
  misc_feature (262)..(262): n is a, c, g, or t
  modified_base (594)..(594): a, c, t, g, unknown or other
  misc_feature (594)..(594): n is a, c, g, or t
tcagagcactgtagcacgaccggtgctcgatttagtgacatctcgcagttctttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctgtaccaacaacacccagcaaacgccccaatcatattangagtcactagcgccctcgagggtccctgatcgcttctctcgccctacaacgccgtgggaccaaaccgtaccggcccctcccgtcggtacccgttcccgtccgtcggggcccttccgacgggtcttacgggagggtattcgggaagggtcctaggttaatttactttagttcgactacgtctacgtatagtgcgaggtctaagttactaagttcgtagtacgttacggttcgggacgggtaacgggaacctaaacgtcgaccgtcgtaacgcacgaccgagcctccgaccctcgcctacgtccgtaccgtccccacctccgtcctactacgcncctcgtacggccgg

SEQ ID NO: 324047 - DNA, 556 bp, Homo sapiens
  misc_feature: GZ8MTXP02JVDA1.4.39.D06.1.454.CMB.2.raw
  modified_base (253)..(253): a, c, t, g, unknown or other
  misc_feature (253)..(253): n is a, c, g, or t
  modified_base (358)..(358): a, c, t, g, unknown or other
  misc_feature (358)..(358): n is a, c, g, or t
  modified_base (380)..(380): a, c, t, g, unknown or other
  misc_feature (380)..(380): n is a, c, g, or t
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgacgttgtacgtataactntagtctctgtaccaacacaccagcaagccccaaatcaatattatgagtcactaagcgaccctgacgggtccctgactcgtcttccctctgccctacgaaggtcgngccaaaccaccggccttcccgngcccgtctccgtggggcctacccgaggctaggagtanaggaggctagattaattctgtnatctatatatagacgagagtagtataatagtagtagtagtacggacggtaacggtaacgtaacgtacgtaccgtacgtaacgtacgtacgaccgacgtaccgtaccgtacccgtccg

SEQ ID NO: 324048 - DNA, 562 bp, Homo sapiens
  misc_feature: GZ8MTXP02F6N0X.4.39.D06.1.454.CMB.2.raw
  modified_base (333)..(333): a, c, t, g, unknown or other
  misc_feature (333)..(333): n is a, c, g, or t
  modified_base (380)..(380): a, c, t, g, unknown or other
  misc_feature (380)..(380): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccggcgtccgggtctccgtggacagtcagtcaccatctcctgcactggaaccagcagtgacgttggtcttataactatgtctcctggtaaccaacaacacccaggacaaacgaccccaaattcaataatttactgaggtcactaagcggaccctnacggggtccctgatcgtcttcctctcgcctcaagtcctagccaaacncggcctaccctgtacctctactcgggctccaggctgagactgaaggtctagtattagttacttggctacgtctactatatcgcaggctagttacaagttgctaagtcgttcggacgggaacggaacctaaacgtcgaacccgtccgtaaaggccaaagccccgaaggctacggccccctcgg

SEQ ID NO: 324049 - DNA, 611 bp, Homo sapiens
  misc_feature: GZ8MTXP02G33I0.4.39.D06.1.454.CMB.2.raw
  modified_base (308)..(308): a, c, t, g, unknown or other
  misc_feature (308)..(308): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
  modified_base (470)..(470): a, c, t, g, unknown or other
  misc_feature (470)..(470): n is a, c, g, or t
tcagagcactgtagcacgaccggtgctcgatttagtgacatctcgcagttcgtttggggggggtctcaggaggcagcgctctcaggacgtcaccaccatggcctgggctctgctcctcctcaccctcctcactcagggcacgagggtcctgggcccagtctgccctgactcagccctccctccgcgtccggtctcctggacagtcagtcaccatcctctgcactggaaccagcagtgacgttggtacttaataactatgtctcctggtaccaacaacacccaggacaaacgccccaaatcataattangagtcactaagcgccctcgagggtcccngatcgtcttcctcgtncctacaggcctgggccaacgaccggtccctacccgtcgtaccgtcgtcgtcgggcctcccggagtccgtaggaggatcggagtctagtattattattcggactatctacagttaacgngacgtacggtactagttaactagtgtaagtaacgttacggtacgggaacgggtaaacggaaccgtaaaccgtaccggtaacccgttacggtaacgtacccgaaccgacccggtacgtcccgttaccccggtaccccgtcgg

SEQ ID NO: 324050 - DNA, 659 bp, Homo sapiens
  misc_feature: GZ8MTXP02JYQII.4.39.D06.1.454.CMB.2.raw
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtcgttaataactatgtctctagtaccaacaactaccagacaaacgccccaaatnatattangagtcactaagccgccctgacgggtcctagactcgtcttcctctcgcctaccgaaggcctacgggccaaccgaccggtcccctccgtacgtacccgttctccgtcggggtcctaccggacgggtctaggtaacgggagtcgggacggttccgttaaggttaacttttaagtttaacgttcggaccgtacggtacttactaagttaagttcgacgtacggtaccgtaaagttaacgtaagttagtacggtaagttacggttacggggaaccgggtaacggaaaccgtaacgaccgtacccgttaacgtaacggaccgtaccggaccgtaacggcccgtacccggtaccccgttaccgg

SEQ ID NO: 324051 - DNA, 574 bp, Homo sapiens
  misc_feature: GZ8MTXP02JBRGX.4.39.D06.1.454.CMB.2.raw
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
  modified_base (314)..(314): a, c, t, g, unknown or other
  misc_feature (314)..(314): n is a, c, g, or t
  modified_base (421)..(421): a, c, t, g, unknown or other
  misc_feature (421)..(421): n is a, c, g, or t
  modified_base (429)..(430): a, c, t, g, unknown or other
  misc_feature (429)..(430): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
  modified_base (459)..(459): a, c, t, g, unknown or other
  misc_feature (459)..(459): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacaggtcctgggcccagtctcgccctgactcacgccctccctccgcgtccggtctccgtggacagtcagtccaccatcctcctgcacgtggaaccngcagtgtacgttggtacgttaataactntcgtctctcgtaaccaacacacccagaccaaacgccccaaattcaattattangagtacaagtaacgccgtccctggcgggtcctgactcgtcttcctctcgcctacgagctacgccaacgcccggtccctccgtcgtaccgtcgtcgtcgggctccggngtctgagnnggngtctagtattnttagtcgactacgtntactaagttgcgtacgagtaccttaagtactaagtgtagtacgtcggtcggaggtaaacgacctaagtccgtacgtcgtaacgacgaccgtaccgacgtccctccgtacccgtcg

SEQ ID NO: 324052 - DNA, 673 bp, Homo sapiens
  misc_feature: GZ8MTXP02HT09I.4.39.D06.1.454.CMB.2.raw
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
  modified_base (335)..(335): a, c, t, g, unknown or other
  misc_feature (335)..(335): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcaggcacagggtcctgggcccagtctgccctgactcagccctccctccgcgtccggtctccgtggacagtcagtcacatctctgcactgaaccngcagtgacgttgtcttataatatgtctctagtaaccaacaacaccaggacaaacgaccccaaattcaattaatttangaggtacataacgcgtaccctcgacgggtccngtattgtccttcctctcgcctaccgaaggtcctaggaccaaacgcccggtacccttccccgtcgtaccctcgtcgtcgggtcctcccgagcttaggaagtataggagtacgttagtaatttagttaatttcggactaacggttcctactaagtacgttacgaccgtaagggtaaccttaaggtttaaacaaaagtttgggtaagttaaagttacgggtttaccggggaacgggaaacggggttaaaaccctaaacggtacccggttaacccggtacgttaaccggtacgaacccggacccgtaacggtcccgtaacccggttacccccgttacccggg

SEQ ID NO: 324053 - DNA, 567 bp, Homo sapiens
  misc_feature: GZ8MTXP02FIW9H.4.39.D06.1.454.CMB.2.raw
  modified_base (457)..(457): a, c, t, g, unknown or other
  misc_feature (457)..(457): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctctgtaccaacacaccagcaacgccccaatcataattatgagtcactaagcgccctcgacggggtccctgatcgcttcctcctgcctaccgaaggctcggccaaccgaccggtccctccccgtgacccgtctcgtcgggcctccgagcctggaggatggagtcgtagtagtttactttagttgacagtcttacgattangacaggtactaagttacaagttgatacgtagttcgggacggtacggacctaaaacgtcgaccgtaccgtaaggtaccgagaccccgaaggtcctaccgcccccgttacgg

SEQ ID NO: 324054 - DNA, 588 bp, Homo sapiens
  misc_feature: GZ8MTXP02JTX26.4.39.D06.1.454.CMB.2.raw
  modified_base (311)..(311): a, c, t, g, unknown or other
  misc_feature (311)..(311): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacgagggtcctgggcccagtctgccctgactcagcctccctccgcgtccggtctcctggacagtcagtcaccatctcctgcacgtcgaaccagctagtgtacgttggtcgttataactatgtctctacgtaaccaacaaccaccagacaaacgccctaaattcaattaattangagtacaacgtaagccgaccctacgacgggtccctgactccgtcttcccgtctcgcctacgacgtcgtgccaaccgcgtccctccgcgaccgtctcgtcgtcctcgaggctagagtagtggaggtctagtattacttagtcgactagtctataagttgacgacgaggtactaaggttaactaagtcgtagtacggtttacgcgggaacggaaacggtaacccagtaccggtctaaccggtaagaccaacggccaacggtccctccggcccttaccgg

SEQ ID NO: 324055 - DNA, 732 bp, Homo sapiens
  misc_feature: GZ8MTXP02J0IE9.4.39.D06.1.454.CMB.2.raw
  modified_base (373)..(373): a, c, t, g, unknown or other
  misc_feature (373)..(373): n is a, c, g, or t
tcagagcactgtagcacgaccggtgctcgatttagtgacatctcgcagttcgtttggggggggtctcaggaggcagtgctctcaggacgtcaccaccatggcctgggctctgctcctcctcaccctcctcactcagggcacgagggtcctgggcccagtctgccctgactcacgcctccctccgcgtccgggtctcctggacagtcagtcaccatctcctgcacgtggaaccagcagtgtacggttggtacttaataactatgtctccgtacggtaccaaacaacacccaggaccaaacgacccctaatcaattaattatgagtacactaacggccgaccctacggacgggtccctggactccgtctttaccncctcgaccctaccgaagccgttacggaccgtaaaccgacccggtcccccttacccgtaccggtaccccgtttccgtccggttaccgggggtccctacccgggtacgggtccggttaaggaccgggtagttacgggaacgggtacctttaggttaagttttaatttaacggtttgaccgtaggtcccttacgtaaagtcgttacggcgaaacggttccgtaaaggtttaaaccagtttaggtacgttaaaggttccggttacggggacggggtaaaaccggtaacccgttaaacgccggtacccgttaacggtcggtaccgacggtacccggaaggtcccgttcccggacccccgtttgg

SEQ ID NO: 324056 - DNA, 640 bp, Homo sapiens
  misc_feature: GZ8MTXP02HC3XJ.4.39.D06.1.454.CMB.2.raw
  modified_base (256)..(256): a, c, t, g, unknown or other
  misc_feature (256)..(256): n is a, c, g, or t
  modified_base (305)..(305): a, c, t, g, unknown or other
  misc_feature (305)..(305): n is a, c, g, or t
  modified_base (509)..(509): a, c, t, g, unknown or other
  misc_feature (509)..(509): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccaccatcctcctgcactggaaccagcagtgtacgttggtcttataactntgtctctagtaccaacaaccaccagacaaacgccccaatcataatttangagtacagtaacgccgtcccgtagacgggtccctagactcgtccttccgtcctcgtaccctaccgaaggtccgtacgggcctaaaccgacccgggtcccccttcccgtaccgtccccgtcgtcccgtacggggtccctaccggaggtcccgttaggagggacgttacggacggtcgttaggtaaactttacgttagtttcgacncggtacttaccgtattactcgacgacgtacgtacgtttaaagagtagtagtacgttacggtacggaacggaacgaacctaacgtcgtaccgtacgaacgtccacgaccgtacgcccgtaccgtcccgtacg

SEQ ID NO: 324057 - DNA, 680 bp, Homo sapiens
  misc_feature: GZ8MTXP02GP7UK.4.39.D06.1.454.CMB.2.raw
  modified_base (259)..(259): a, c, t, g, unknown or other
  misc_feature (259)..(259): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtcccggtctcctggacagtcagtcaccatcctcctgcactggaaccagcagtgacgttggtacttaataactatntctcctggtaaccaaacaaccacccaggacaaacgaccccaaatcaataaatttatgtagtacaactaagcgccctcgacggggtcctagtactccgtcttccctctcgtccctaccgaaggtcctcgggaccaaaccgaccggtacccctcccccttacggtacccgttcttccgggtcggggtcccttaccggacgggtccgttaggaggagttggaacggcgttagtatttagttaagttcgacgtagtctacgtatacgtcgcgtaacgtacgtaacggttaaataaagttgtaagtaacgtttagggttaccggggacgggtaaacgggaaacctaaaaccgtcggtaacccgttaccgtaacggtaccgaaacgaccccggtaacggtcccgtacccggtaccccgtttcccggg

SEQ ID NO: 324058 - DNA, 562 bp, Homo sapiens
  misc_feature: GZ8MTXP02GQLJF.4.39.D06.1.454.CMB.2.raw
  modified_base (259)..(259): a, c, t, g, unknown or other
  misc_feature (259)..(259): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacgagggtcctgggcccagtctgccctgactcagcctccctccgcgtccggtctcctggacagtcagtcacatcctctgcactggaaccagcagtgagttgtcgttaataactatgtctccngtacaacaacaccagacaacgcccaaatcataattatgagtcactagcgccctgacggtcctgactcgtctcctctgtcctaccaaggtcttggctaacgcggtaccctcccgtcgacccgtctcgacgggctccgagctggagtagcgtagctgattacttagtgacagtcttcgatgtagcgtacggctaaagtagtaaagttggtataacgttacgttaccgggacggtaaacggaaaccaacgttacgacccgtttacgaagttcgaccgtacgaacgccgtacccggtccccgtaccg

SEQ ID NO: 324059 - DNA, 581 bp, Homo sapiens
  misc_feature: GZ8MTXP02GOMEK.4.39.D06.1.454.CMB.2.raw
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
tcagagcactgtagcacgaccggtgctcgatttagtgacatctcgcagttctttggggggggtctcaggaggcagcgctctcaggacgtcaccaccatggcctgggctctgcctcctcctcaccctcctcactcagggcacagggtcctgggcccagtctgccctgactcacgccctccctccgcgtccgggtctcctggacagtcagtcaccatctcctgcactggaaccagcagtgacgttggtcgttataactatntctctgtaccaacacaccagacaaacgaccccaatcatattangagtcactaagccgaccctcgacgggtccctgactcgtcttccctctcgtcctaccgaaggtcctggccaaacgccggtcctcccgtcgaccgtctcgtcgggctccgacgctaggacgagtcggaagctagtattattagttcgacgagtctacagttagtacgcgagtctaaacgttcaagtgttagattacggttacgggacggtaacgggaaccctaaacggtacgaccgtttacgaacggtcgacgtaccgacgtccgtccgtacccccgttcg

SEQ ID NO: 324060 - DNA, 627 bp, Homo sapiens
  misc_feature: GZ8MTXP02I0CC7.4.39.D06.1.454.CMB.2.raw
  modified_base (312)..(312): a, c, t, g, unknown or other
  misc_feature (312)..(312): n is a, c, g, or t
  modified_base (502)..(502): a, c, t, g, unknown or other
  misc_feature (502)..(502): n is a, c, g, or t
  modified_base (520)..(520): a, c, t, g, unknown or other
  misc_feature (520)..(520): n is a, c, g, or t
tcagagcactgtagcacgaccggtgctcgatttagtgacatctcgcagtttctttggggggggtctcaggaggcagcgctctcaggacgtcaccaccatggcctgggctctgctcctcctcaccctcctcactcagggcacgagggtcctgggcccagtctcgccctgactcagccctccctccgcgtccggtctccgtggacagtcagtccaccatctcctgccacgtacggaaccagcagtgtacgttggtacttataactatcgtctctacgtacaacacaccagacaaacacccctaaatcataattntagagtacacacgccggtccctggtacggtcctgtactgtcttccgtctcgtacctacgaacgtccgttcggaccaccgtaccggcccttacccgtccgtacccgttcgtcggttcgggcccttacggacggtcgtagacggtagtgggaaggtctagttattagttatgactaagtctaacgattacgngacgtagtacttagtaanagttgaagttaacggtacggtacggggaacggaaacgtaaaccgtacgtccgtaaccgtacgaacgtacgaccgtacgaaccggtccccgtaccggtccccgtacgg

SEQ ID NO: 324061 - DNA, 651 bp, Homo sapiens
  misc_feature: GZ8MTXP02HTY11.4.39.D06.1.454.CMB.2.raw
  modified_base (230)..(230): a, c, t, g, unknown or other
  misc_feature (230)..(230): n is a, c, g, or t
  modified_base (302)..(302): a, c, t, g, unknown or other
  misc_feature (302)..(302): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcacgtggaaccngcagtgacgttggtacttataactatcgtctcctagtaccaacaacaccagcaaacgcccaaatcataattngagtcatagccgctcgagggtccctgactcgtcttccctacgtcgtaccctacgaaggtccttagggacccaacgtacccggcccctaccccgtaggaccccgttctcggtcggcctcccgaggcgtggaaggtagtacggacgtcttaggtaattttagttaacttggactacggtacttacgtaagttaagtacgacgtaggtactaaacggttaactagttagtaacggtaacgttacgggttaccggggaacggtaaaccgggtaaacctaaaccgttacggtaacccgttacgttaacggaccgaaccggtacccggtacgtcccgtaccccggtacccgtccg

SEQ ID NO: 324062 - DNA, 646 bp, Homo sapiens
  misc_feature: GZ8MTXP02JV9ZK.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtcccgggtctcctggacagtcagtccaccatcctcctgcactggaaccagcagtgacgttggtacgttataactatgtctctgtaaccaacaacaccaggacaaacgaccccaaatcataattatgagtcactaacgccgccctcgacggggtccctgactcgtcttccgtctcgcctaccgaaggctcggaccaaccgaccggtccctcccgtcgacccgttcgtccgtcggggccctccggaggtctaggacgtatcggaagggtctaggtatttattagttgacgtagtccttactagtatacgcggaaggtactaaaggttacaagttcggtaaagtacgttacggttaacgggggaccgggtaaacggggaaaccctaaacggttaccggaaccccggttacggtaacggtacccgaacggacccgaacggtcccgtacccccggtaccccgtcccgg

SEQ ID NO: 324063 - DNA, 571 bp, Homo sapiens
  misc_feature: GZ8MTXP02HY2DH.4.39.D06.1.454.CMB.2.raw
  modified_base (306)..(306): a, c, t, g, unknown or other
  misc_feature (306)..(306): n is a, c, g, or t
  modified_base (432)..(432): a, c, t, g, unknown or other
  misc_feature (432)..(432): n is a, c, g, or t
  modified_base (447)..(447): a, c, t, g, unknown or other
  misc_feature (447)..(447): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtcgttataactatgtctcctggtacaacaacaccagacaaacgaccccaaattcataatttangagtcactaagccgccctcgacggggtccctgactcgcttcctctcgcctccagctgcaacgacgccctccctcgacctcttctcgggtcctccgagctgacgagtgaggctgtatttattacttnacgagtctacattanggacagggtcaagtttacaagttagtgaattacggttacggacggacgggttaaaccaaacgtacgtacccgtacgttaacggtccgaacgacccgaaaggtccctccggacccccgtttccgg

SEQ ID NO: 324064 - DNA, 594 bp, Homo sapiens
  misc_feature: GZ8MTXP02I76ZD.4.39.D06.1.454.CMB.2.raw
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
  modified_base (329)..(329): a, c, t, g, unknown or other
  misc_feature (329)..(329): n is a, c, g, or t
  modified_base (408)..(408): a, c, t, g, unknown or other
  misc_feature (408)..(408): n is a, c, g, or t
tcagagcactgtagcacgaccggtgctcgatttagtgacatctcgcagtttctttggggggggtctcaggaggcagcgctctcaggacgtcaccaccatggcctgggctctgctcctcctcaccctcctcactcagggcacagggtcctgggcccagtctcgccctgactcagccctccctccgcgtccgggtctcctggacagtcagtccacatctcctgcactggaaccagcagtgacgttggtcgttataactntgtctctgtacaacacaccagacaacgcccaatcatatttangagtcactagccgccctcgacgggtccctnactcgtcttcctctgtcctaccgaagcctgggacaaccacggtccctcccgtagacccgtctcgtcgctccgagcgtgnggatggacgctgtattagttatgcacgtctacattaagcgtacgaaggtacgtaaacgtttagtaaagttggtagtaagttacggttacggggacgggtaaacggaaacgtaaaaccgtcggtaacccgttcggtaacgtacgaccgtacccgtaaggccccccccttaggtcccccgtttaccgg

SEQ ID NO: 324065 - DNA, 775 bp, Homo sapiens
  misc_feature: GZ8MTXP02GQ9C3.4.39.D06.1.454.CMB.2.raw
tcagagcactgtagcacgaccggtgctcgatttagtgacatctcgcagttctttggggggggtctcaggaggcagcgctctcaggacgtcaccaccatggcctgggctctgctcctcctcaccctcctcactcaggcacagggtcctgggccagtctgccctgactcacgcctccctccgcgtccgggtctcctggacagtcagtccaccatcctcctgccactaggaaccagctagtcggtacggttcggttacgttaataactatcgttctccgtacggtaaccaaaccaccacccgaggaaccaaacccgaccccctaaattccaaatttaaactttagtacggtaacgtactaacgtaacggtccggacccctcggaccgggttccctgtacgtcgtaccttcccctcgtacgtccccgtaccgtaaggtcccgtacggacccgaaaccgtacccgggtcccccttaccccgttaccggtaccccgtttccgtccggttaccgggggtccccttacggaccggggtccgttagggaacggtacgtcgggacgttacgttaagttactttaagttagtcgtaacggtcttccgtacaagtttagcccgaggttaacggcctttaaaggttaaaccagtttaggacgttaaacgttcgggttaccggggaacggggtaaaaccgtaaccgtaaccggttacccgttacccccggtagtaacgggttacccacgggttacccccgaacgttccccgccccgttacccccggtcg

SEQ ID NO: 324066 - DNA, 607 bp, Homo sapiens
  misc_feature: GZ8MTXP02IKZCV.4.39.D06.1.454.CMB.2.raw
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (329)..(329): a, c, t, g, unknown or other
  misc_feature (329)..(329): n is a, c, g, or t
  modified_base (399)..(399): a, c, t, g, unknown or other
  misc_feature (399)..(399): n is a, c, g, or t
  modified_base (463)..(463): a, c, t, g, unknown or other
  misc_feature (463)..(463): n is a, c, g, or t
tcagagcactgtagcacgaccggtgctcgatttagtgacatctcgcagttctttggggggggtctcaggaggcagcgctctcaggacgtcaccaccatggcctgggctctgctcctcctccaccctcctcactcagggcacagggtcctgggcccagtctgccctgactcagccctcctccgcgtccggtctcctggacagtcagtccacatctcctgcacgtggaaccagcagtgtacgttgtacgttataactntgtctctgtaccaacacaccagacaaacgccccaatcatattngagtanagtagccgaccctcgacgggtccngatcgtcttcctctcgcctacgaggtctgccaacgccggccctcccgtcgtaccgtctcgtgctacccgnggactggacgtatggacgtcgtagtaattagttaagttcgacgtagtacctacgtaagttacgngaaccgtagggtaaacttaggttaaacctaagtcggttaagtacgttaacggtcggggaaccgtaaaacgggaaaccttaaacgcggtaaccgttccggtaagccgtaaaccgaccgtaaggcccctaccggtcccttaaccgg

SEQ ID NO: 324067 - DNA, 599 bp, Homo sapiens
  misc_feature: GZ8MTXP02FK7AI.4.39.D06.1.454.CMB.2.raw
  modified_base (300)..(300): a, c, t, g, unknown or other
  misc_feature (300)..(300): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctctggtaccaacaacaccagcaaacgccccaaatcataatttangagtcactaagccggaccctcgacggggtccctgactcgcttccctctcgcctaccaaggtcttcgggccaaaccgaccggtcccttaccccgtgaccccgttctccgtcgggccctccgaggtcgtggaggtatggacggtctgtatttatttagttgacagcttacagttatcgcgaggctaagttacaaagttcgtataagttaggttacgggacgggtaacggaaccgaaacgtcggaaccgttaccgtaaggtccgaacgacccgtaaacggccgtacccggcccccgttccgg

SEQ ID NO: 324068 - DNA, 765 bp, Homo sapiens
  misc_feature: GZ8MTXP02IAHMM.4.39.D06.1.454.CMB.2.raw
  modified_base (299)..(299): a, c, t, g, unknown or other
  misc_feature (299)..(299): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcaggcacagggtcctgggcccagtctcgccctgactcagccctccctcgcgtccggtctcctggacagtcagtcaccatctcctgcactggaaccagcagtgacgttgtcttataatatgtctctgtacaacaccaccaggacaaacgcccctaaatcaataatttangtacggtacacgtaacgccggtccctacgtacggggtcccctagtacgtccgtcctttcctcgtaccgtcccgttaccgaaggtccgttcggacccgaaccgtacccggtccccctttaccccgtacggtaccccgttcgttcccggtccgggtacccttccccggaaggtccgttaggaaccggtaagtcggtacggtacccgttaaggttagtttaatttaacgttcggtacctaacggtcctttaaccggaatttcgaccggtacggttaacggtaccgttaaaacggtttacgtaaaggtttccgggttaacgttaaagtttacccgggtttacggggaccggggtaaaaccgggtaaaacccgttaaccggtacgttaaccccgggttaccgttaaccggtacccgaacggtacccccgtaaacgggtcccgtttaaccccggtccccccggtttaaccgg

SEQ ID NO: 324069 - DNA, 523 bp, Homo sapiens
  misc_feature: GZ8MTXP02F4BUD.4.39.D06.1.454.CMB.2.raw
  modified_base (265)..(265): a, c, t, g, unknown or other
  misc_feature (265)..(265): n is a, c, g, or t
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
  modified_base (374)..(374): a, c, t, g, unknown or other
  misc_feature (374)..(374): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (514)..(514): a, c, t, g, unknown or other
  misc_feature (514)..(514): n is a, c, g, or t
tcagagcactgtagcacgaccggtgctcgatttagtgacatctcggcagttctttggggagctctgggagaggagccccagccctgagattcccacgtgtttccattcagtgatcagcactgaacacagaggactcgccatggagtttgggctgagctgggttttcctgttgctatttaaaggtgtccaatgtgaggtgcaactggtggagtctgggggaagtgtggtacggctgggggtccctgagactctcctgtacagcctntggattctcttgatgattatggcatgacgctgggtcnccaagctccgagggagggctaggagtcgggtntctggtatgaattcggagttggcggtagtacagtcttagngcagctgtgagagcatcactncanaganactacacaagtacctctatactcagactaatcgaaactgtactagaagcgtacggaagtcgtacggtacttagtactacgtggaacgacgtaacgtacgttaggttacgggntacggtagg

SEQ ID NO: 324070 - DNA, 682 bp, Homo sapiens
  misc_feature: GZ8MTXP02GNGGQ.4.39.D06.1.454.CMB.2.raw
  modified_base (569)..(569): a, c, t, g, unknown or other
  misc_feature (569)..(569): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcacgcctccctccgcggtccgggtctccgtggacagtcagtccacattcctcctgcacgtacggaaccagcagtcggtacgttggtacgttaataactatcgtctacctacgtaaccaacaaccaccaggacaaccgacccctaaatacaattaattatgaggtaccaagtaacgccggcctacgacggggttcctagactcgtcttcccgctcgacctaccgaacgcgttacgaccaaccgaccggcccttacctcgtaccgtccgtacgtcgggacccttaccggaggtccgttaggaagggtacgtacgggtaacgtcgtttaaggtattttaagttaaaccggttgaaccgtacggtactttaccggaattacgcgtacgaaggtctaaacggttanaaggtttgtagtaccttagggttaccggacggggaaaccgtaaacgtaaccgccggttacccggttacgaacgttccgaaaccgtcggaccgtccacccggtacccggtcccg

SEQ ID NO: 324071 - DNA, 692 bp, Homo sapiens
  misc_feature: GZ8MTXP02G905N.4.39.D06.1.454.CMB.2.raw
  modified_base (312)..(312): a, c, t, g, unknown or other
  misc_feature (312)..(312): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacgagggtcctgggcccagtctcgccctgactcagccctccctccgcgtccggtctcctggacagtcagtcaccatcctcctgcactggaaccagcagtgtacgttggtacgttataactatgtctctagtaccaaacacaccagaccaaacgaccctaaattcaattaattanagagtacaacgtacgccgtccctacggacgggtccctagtactcgtcttcctactcgtcctacgacgtccgtagacctaacgaccggtccctacccgtcgacccgtcgtcggtcgggtcctacccggagtccgtagggaacggtagtcgggtacggtacgtttagtaactttagttaacgttcgacgtaacgtcttacgtaagtacgtacggacgtaacggttacgtaaagtttagaagtttggtaacgttaagttacgggttaccggggaaacgggttaaacgggaaaacccttaaaaccggtcgtaccccggtttaacgtaacggtaccaacccgggtaccgtaaccgggtcccctaacccggggtcccccttacggg

SEQ ID NO: 324072 - DNA, 529 bp, Homo sapiens
  misc_feature: GZ8MTXP02FR1RW.4.39.D06.1.454.CMB.2.raw
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
  modified_base (369)..(369): a, c, t, g, unknown or other
  misc_feature (369)..(369): n is a, c, g, or t
  modified_base (394)..(394): a, c, t, g, unknown or other
  misc_feature (394)..(394): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgacgttgtcgttataatatgtctctgtacaacaacaccagacaaacgccccaaatcatattangagtcataagcgacctgacggtccngatcgcttcctctcgcctcgagctgcacacggcctccgtgaccgtcnctcggtcctacaggctaggagtacnggagtctgtaattcttatcgcagctacgatatcgacgtagctagtactaagtgtacatacgtcggacggtaacgggactaaacgttacgaccgttacgaacgtaccgacgacccgtagtcctacgccccgttacg

SEQ ID NO: 324073 - DNA, 577 bp, Homo sapiens
  misc_feature: GZ8MTXP02GSO56.4.39.D06.1.454.CMB.2.raw
  modified_base (300)..(300): a, c, t, g, unknown or other
  misc_feature (300)..(300): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
  modified_base (456)..(456): a, c, t, g, unknown or other
  misc_feature (456)..(456): n is a, c, g, or t
tcagagcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcacgcctccctccgcgtccggtctcctggacagtcagtcaccatctcctgcactggaaccagcagtgagttggtcgttataactatgtctctgtaaccaacacaccagacaaacgccccaaatcaataattanagagtcaataagcgccctgacgggtcctgatcgtcttacctctcgcctaccgaagcctggacctaaccgaccgtccctcccgtcgtaccgtctcgcgggcctccgagtctaggagtagnggacgntagtattattagtgctagtntactagttacngacgagtagtaagttataagtgtagtagttacggtcggaacggaaacggtaacctaacgtaccggtaaccgtacgtaacgaccgtaaccggaccgtacggtacccgtccccgtacccgtcg

SEQ ID NO: 324074 - DNA, 680 bp, Homo sapiens
  misc_feature: GZ8MTXP02FFWK9.4.39.D06.1.454.CMB.2.raw
  modified_base (233)..(233): a, c, t, g, unknown or other
  misc_feature (233)..(233): n is a, c, g, or t
  modified_base (309)..(309): a, c, t, g, unknown or other
  misc_feature (309)..(309): n is a, c, g, or t
tcagagcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcacgcctccctccgcgtccgggtctccgtggacagtcagtcaccatcctcctgcacgtggaaccngcagtgacgttggtacgttataactatgtctcgtgaaccaacacaccaggacaaacgccccaaatcaataatttanagagtcaacgtagccgacccgtagacggggttccctagatccgtcttccgtcgtaccgcctaccgacggtcgttaccgggaccaaaccggcccggtcccttacccgtacgtaaccccgttcgttccggtaccgggggtccctacccggtaacgggccttagggaacgggtagtaccgggaaggttcccgttaggttaactttaattacgttcgaacgtcgtctacgtagttaactcggcgtaacgtacgttaaagtaacgtagttggtaacgttacgttaaccgggtggggtaccggtaaaggacccaaaacggttccgaaccgtttcgaacggtacgacgaccggaacgtccgtcccgtccccgtaacgg

SEQ ID NO: 324075 - DNA, 567 bp, Homo sapiens
  misc_feature: GZ8MTXP01CM5NW.52.36.D03.1.454.CMB.2.raw
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactagggggaaaattatgctgactggtaccagcagaagccaggccaagcccctgagtgtgatatacgaaaatagtgagcgctaccgtggactcctcgaccgattctcgtgggtcccacctcgagggaaagccgacccacctgaccatacaacgagggtccgataggaagacggagctaggacttacgttactgtacttgggtcgtaggggatgaggactacgtagttagggtgttcggggcggtaacgggccaaaggccgttacggacccgttccgtaccggtcacggcccgaacgggtcctccggccccctcgggtccaccgttccgttcgttcccccc

SEQ ID NO: 324076 - DNA, 595 bp, Homo sapiens
  misc_feature: GZ8MTXP01AWTN3.52.36.D03.1.454.CMB.2.raw
  modified_base (575)..(575): a, c, t, g, unknown or other
  misc_feature (575)..(575): n is a, c, g, or t
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactaggggaaaaattatgctgactggaccagcagaagccaggccaagcccctgagttggtgatataacgaaatagtgagcgctacccgtgggactccctcgaccgtattccgtcgtcgggtacccaccgtcgaaggggaacgaccggacccaccctgaacccataccgaaacgacggggttaccggaacgtacggaaaggaaccggagggcctagaacttattacctgtcttggggtcgtgggggatgggacggacacgtagttgggtcggttccgggacggacgggacccaaggccttggaacccgttccgtaacggcacggcccaaggcctccgccccctggtccnccgttccgttcgttcccccg

SEQ ID NO: 324077 - DNA, 576 bp, Homo sapiens
  misc_feature: GZ8MTXP01EPM72.52.36.D03.1.454.CMB.2.raw
  modified_base (455)..(455): a, c, t, g, unknown or other
  misc_feature (455)..(455): n is a, c, g, or t
  modified_base (480)..(480): a, c, t, g, unknown or other
  misc_feature (480)..(480): n is a, c, g, or t
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagctttccctcggtgtcagtgtccccaggacagacagccaggatcacctgctctggagatgtactaggggaaaaattatgctgactggaccagcagaagcaggccaagcccctagagttggtgatataacgaaaatagtgaagcgactaccgtgggaactcccgtagaccgtattctcgtcgggtacccaaccgtcgaaagggaaacgacccgacccgtacccctaggaaccactaccaacgacgggtaccggaacctaggaaagacggagggactgaactacttacgngtcttgggtcgtggggatggagacngtagttggtgtcgggacggacggaccaagcttacggaccgttccgtaacgcacgcccgaggtccaccgccccgtcggtcacttccttcgttccccc

SEQ ID NO: 324078 - DNA, 616 bp, Homo sapiens
  misc_feature: GZ8MTXP01CVXV4.52.36.D03.1.454.CMB.2.raw
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagccttccctcggtgtcagtcgtccccaggacagacagccaggatcacctgctctggagatgtacgtaggggaaaattatgctgactggaccagcagagccaggccaagcccctgagttgtgatataacgaaaatgagagcgctacccgtgggactcccgtacgaccgtattcctcgtcggggtaccctacccgtcgaagggaaacgaccgaccacccacgaccataccaacgtacgggtccgactagaacggacgacggctgaacttattaactgtacgttgggtcggtaggggtatcggaaggactacgtagttgggtcggttcggggcgggtaaacgggcgaaacggtccgttacggtacccgttcccgttaaccggcttaaccggcccgttaacggcccgtaccggcccccgtcgggtaccaccgttcccgttcccgttaaccccc

SEQ ID NO: 324079 - DNA, 556 bp, Homo sapiens
  misc_feature: GZ8MTXP01BBBML.52.36.D03.1.454.CMB.2.raw
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactaggggaaaattatgctgactggtaccagcagaagccaggccaagcccctgacgttggtagatatacgaaaatgtagagcgactaccgtggactcctcgaccgattcgtctgggtacccaccgtcgagggaacgacgaccacctgaccatcaacagggtccgatgaagacgaggctagactattacgtgtcttgggtcttagggggattggaagacacgtaagttgggtgttacgggcggagggaccaaaggtcttggaacccgttcgtaaaccgtcgacgccccgaaggcctcggccccctcggtcacctcgttaaccgttccccc

SEQ ID NO: 324080 - DNA, 546 bp, Homo sapiens
  misc_feature: GZ8MTXP01CEDSG.52.36.D03.1.454.CMB.2.raw
  modified_base (472)..(472): a, c, t, g, unknown or other
  misc_feature (472)..(472): n is a, c, g, or t
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactaggggaaaattatgctgactggaccagcagagcaggccaagcccctgagtgtgatataacgaaatagtagagcgtctacccgtggactcctcgaccgattcgtcgtgggtacccaccgtcgagggaaacgaccgacccacccgtacgaaccactacaaacgacggggtaccgacgtagaaagacggaggctagactattactgcttggtcgtggggatggaggaccagagttggtgtcgggnggacgggacaagcttgaccgttcgacgtcacgttcccaggcctcgcccccgtggtccacttccgttcgttcccc

SEQ ID NO: 324081 - DNA, 688 bp, Homo sapiens
  misc_feature: GZ8MTXP01ERCMJ.52.36.D03.1.454.CMB.2.raw
  modified_base (248)..(248): a, c, t, g, unknown or other
  misc_feature (248)..(248): n is a, c, g, or t
tcagcgcagtacgacacgaccggtgctcgatttagctgcgtcacgatctctcttgggggtgggctcaggaggcagagctgtgggtgtctcaccatggcgtgtgccacactcctgctcccactcctcaacctctacgcaggctctgttgcctcctatgagctgacacagtccttccctggtgtcagtcgtccccaggacagacagccaggatccacctgctcgtggagtatgtaagtaagggaaaattngctagacgtaggtacagcaagaacgccgacggaccaacgccccgtaggtagttggtagaattaagtaaacgtaaaagttaggtagacgccgtacccgtaacccgtggggtacctcccccgtacggtaccgtacgtttccgtccgttaaccgggtcccaaccgtcggaaacgggaaaccgacccgaccctacccgtacgaacctacgtacgaaacggtacgggtaccgacgtaaggaaacggacggaaggtctaacgtacttagttacgtcggttcggttcggtcgggtaggggagtacggtaggaccttagtacggtttggtcgggttacggggacgggtaacggggaacaacggttcgtaccgaccgtccgtaacgttccgccggttacccgaacggcccttcccggccccgtacggttcctaacccgtttcgtccccc

SEQ ID NO: 324082 - DNA, 648 bp, Homo sapiens
  misc_feature: GZ8MTXP01BGS4K.52.36.D03.1.454.CMB.2.raw
  modified_base (249)..(249): a, c, t, g, unknown or other
  misc_feature (249)..(249): n is a, c, g, or t
  modified_base (366)..(366): a, c, t, g, unknown or other
  misc_feature (366)..(366): n is a, c, g, or t
tcagcgcagtacgacacgaccggtgctcgatttagctgcgtcacgatctctcttgggggtgggctcaggaggcagagctgtgggtgtctcaccatggcgtgtgccacactcctgcctcccactcctcaacctctacgcaggctctgttgcctcctatgagctgacacagtccttccctggtgtcagtcgtccccaggacagacagccaggatcacctgctcgtggagtatggtaacgtagggaaaattntgctagactggtaccagcaagaacgccgaacggacccaacgccccctggtacgttggtagaattaagtaacgaaaagtagtagacgcgtacctaccgtggactccccctaggacgtnttcctcgtacgggtacccaaccgtacgaacgggaaacgacccgtacccgaccctacgaccctataccgaaacgacggggtaccgaacgtaggaaacggaccgaggtacgtagtacttaagttacgtcggttacgttcggttcggtagggtagtaggaacggactacgtaggttggtcggttacgggcgggtacggaacgtaacgcgtacgacccgtccgtacgttccgcgacccgtaaggcccgtccggtccccgtcggttcctaaccttccgttaaccccg

SEQ ID NO: 324083 - DNA, 677 bp, Homo sapiens
  misc_feature: GZ8MTXP01AVNYB.52.36.D03.1.454.CMB.2.raw
  modified_base (246)..(246): a, c, t, g, unknown or other
  misc_feature (246)..(246): n is a, c, g, or t
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagccttccctcggtgtcagtgtccccaggacagacagccaggatcacctgctctggagtatgtacgtaggggaaaaattntgctgactggaccagcagaacgccaggccaacgcccctagagttggagataataacgaaaagtgtagacgcgacttacccgtggtactccgtacgaccgtattctcgtcggtaaccaccgtcgaagggaaacgaccgaaccccacccgtacgaacctacgtaccgaaacgtaccggggtaccgaaccgtaggaaacggacgagggtactacggtaaccttattaccgtgtaccgtttggggtacggtggggtaactaggaacggtaccgtacgttaacggtttggggtacgggttaccgggggaaccgggtaacgggaacccaagggtcccgttacggacccgttccgtaaccgtaccgaccggttcccgaacggtccctcccggaacccccgttcggtacccgttaccttcccgttccgttaaccccccc

SEQ ID NO: 324084 - DNA, 646 bp, Homo sapiens
  misc_feature: GZ8MTXP01CS0T5.52.36.D03.1.454.CMB.2.raw
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagccttccctcggtgtcagtcgtccccaggacagacagccaggatcacctgctctggagtatgtaacgtagggggtaaaattgtgctgactggaccagcagaacgccgaggccaacgcccctgagttggtagaataataacgaaaatgtagagcgctacccgtggactccgtacgaccgtacttcgtcgtcggtacccaccgtcgaacgggaacgaaccgacccacccgtacgaaccactaccgaaaccggacggggtaccgacgtagaaacggacggacggtactaggtacttacttacgtcgtcgtttaggggttcggtaggggtacttaggaacggtacgtacgttggttacgggttgggttccgggacggggaacggaccgaaggtccgttacggtaccgttcccgtaacggtcaccgttccgaacggtccctcccgtccccgtggtcccttacgttcccgttccgtttaaccccc

SEQ ID NO: 324085 - DNA, 505 bp, Homo sapiens
  misc_feature: GZ8MTXP02JJ4GS.52.36.D03.1.454.CMB.2.raw
  modified_base (241)..(241): a, c, t, g, unknown or other
  misc_feature (241)..(241): n is a, c, g, or t
  modified_base (285)..(285): a, c, t, g, unknown or other
  misc_feature (285)..(285): n is a, c, g, or t
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaattntgctgactggtaccagcagaagccaggccaagcccctgagttgngatatacgaaaatagtagagcgctaccctgggactccctgaccgattctctggtccactcgagggaagacgaccacctgaccatacaacgaggtccgactgaagacgaggctgactatactgcttgtcgtggggatggagacacgagttggtgtcgacggaggacaacgctagaccgtctacgtcacgccaaggctcgcccctcggtcactctcgtcccc

SEQ ID NO: 324086 - DNA, 551 bp, Homo sapiens
  misc_feature: GZ8MTXP02IXHAZ.52.36.D03.1.454.CMB.2.raw
tcagcgcagtacgacacgaccggtgctcgatttagctgcgtcacgatctctcttggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactaggggaaaattatgctgactggtaccagcagaagccaggccaagcccctgagttgtgatatacgaaaatgtgagcgctaccctgggactccctgaccgattctctgggtcccactcgagggaacaccgacccaccctgaaccataccaaacgacggggtcccgacgtaggaaagacgagggctaggaaccttattactgctttgtcgtgggggatggaggaccagtattgggtcgttcgggaggacgggacccaaagtcgtacgacccgtctacgtcaacgcccgaaaggcctcgccccgttcggccactctcgttcccccg

SEQ ID NO: 324087 - DNA, 529 bp, Homo sapiens
  misc_feature: GZ8MTXP02GMLUV.52.36.D03.1.454.CMB.2.raw
  modified_base (287)..(287): a, c, t, g, unknown or other
  misc_feature (287)..(287): n is a, c, g, or t
  modified_base (514)..(514): a, c, t, g, unknown or other
  misc_feature (514)..(514): n is a, c, g, or t
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactaggggaaaattatgctgactggtaccagcagaagccaggccaagcccctgagttggngatataacgaaaatagtagagcgctaccgtgggactcctgaccgtattctcgtcgggtcccactcgaagggaacgaccgacccacctcgaccactacaacgaggtcccgactagaagacgaggctgaactattactgtcttgtcgtggggatggagacagtagttggtgttcggcggaggaaccagctgaccgtcacgtcacgccagccgtcgccccgtcggtaccncgttcctcgttcccc

SEQ ID NO: 324088 - DNA, 583 bp, Homo sapiens
  misc_feature: GZ8MTXP02H5MVZ.52.36.D03.1.454.CMB.2.raw
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
  modified_base (298)..(298): a, c, t, g, unknown or other
  misc_feature (298)..(298): n is a, c, g, or t
  modified_base (345)..(345): a, c, t, g, unknown or other
  misc_feature (345)..(345): n is a, c, g, or t
  modified_base (483)..(483): a, c, t, g, unknown or other
  misc_feature (483)..(483): n is a, c, g, or t
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtacgtaggggaaaaattntgctgactggtaccagcagaanccaggccaacgcccctgaggtttggtagatanaacgaaaaatgtgagcgctaacccgtgggactccctgaccgattccncgtggtcccactcgaagggaagacccgacccacccgtgaaccactacaaacgacgggtcccggaactaggaagacggaggctagaacttattactgtcttgtcgtggggatggaggacactagttgggtgttacgggngggtacgggaacccaaggccgtacggaacccgttccaacggttcgaacgcccgaacgggccttccggccccctcgggtccaccgttcctccgttaccccc

SEQ ID NO: 324089 - DNA, 537 bp, Homo sapiens
  misc_feature: GZ8MTXP02F6CJS.52.36.D03.1.454.CMB.2.raw
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactaggggaaaattatgctgactggtaccagcagaagccaggccaagcccctgagttggtgatataacgaaaatagtgagcgctacccgtgggactcccgtgaccgattctcgtcggtcccactcgagggaacgaccgacccaccctgaccataccaaacgagggtcccgatagaagacgaggctagactatactgcttgtcgtggggatggaggacacgtagttggtgttcgggcgggaggaccaaggcgtacgacccgtactacgtcacgcccgaagccgtccgcccctggccactcgtcgttccccc

SEQ ID NO: 324090 - DNA, 656 bp, Homo sapiens
  misc_feature: GZ8MTXP02HM7WX.52.36.D03.1.454.CMB.2.raw
  modified_base (632)..(632): a, c, t, g, unknown or other
  misc_feature (632)..(632): n is a, c, g, or t
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtcgtcccaggacagacagccgaggactccacctgcttcgtaggagtagttacggtaacggtaaggggtaaaaattagtgtactagacgtcggtaccagacaagaacgccgacggaccaaccgccccgtgtacggttggtagaatagtaaaacgaaaagtgtaggacgcgtaccctaccggtagggtacctcccgtaccgtacccgtatttccgtacggttcgggtacccctaccgtccggaaggggaaaccacccgaaccccacctacgaccactaccgaaacgaccgggtaccgacgagaacgacgagctagacttagtacgtgtcgttgcggtgggataggacgacagtagttggttagtcgggacgggacgggaacctacggcgtcggtacccgttcgtacgacgaccgcccgaaggtcccgtcccgtcccccggtacgtacccnccgtttccgttaccggtccccccg

SEQ ID NO: 324091 - DNA, 576 bp, Homo sapiens
  misc_feature: GZ8MTXP02H5825.52.36.D03.1.454.CMB.2.raw
  modified_base (244)..(244): a, c, t, g, unknown or other
  misc_feature (244)..(244): n is a, c, g, or t
  modified_base (290)..(290): a, c, t, g, unknown or other
  misc_feature (290)..(290): n is a, c, g, or t
  modified_base (325)..(325): a, c, t, g, unknown or other
  misc_feature (325)..(325): n is a, c, g, or t
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtcgtccccaggacagacagccaggatcacctgctctggagatgtacgtaggggaaaattnagctgactggtaccagcaagagccaggccaacgcccctgagttggnatatacgaaaatgtagagcgctaccgtggactccngaccgtattctcgtcggtcccaacgtcgaagggaacgaccgacccacccgtcgaaaccctataccaaacgacggggtacccgacgtaggaaacgacgacggctacggaacttattacgtgtcgttgtcgtgggatggacgacacgtagtttggtggttcgggacgggacggaccgaagcgtacgaccgtcgtacgtacgacgcccgaaggccgtaccgccccgtacggtacctccgtaccgttcccgtccc

SEQ ID NO: 324092 - DNA, 621 bp, Homo sapiens
  misc_feature: GZ8MTXP02JUVTF.52.36.D03.1.454.CMB.2.raw
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtacgtaggggaaaattatgctgactggtaccagcagaagccaggccaacgcccctagagttggtgatataacgaaaatagtgacgcgctaccgtggactccgtacgaccgtatctcgtcgggtccacctcgaagggaacgaccgacccacccgtcgaccataccaacgacggggtcccgaacgtagaaagacggaggcgtacggaacttacttacgtagctttggtcgtagggggatagggaagtacgacgtaggttagggtcggtttcggggacgggtaaggggacccgtaaagggtccgtacggacccgttaccggtaccgtccgaaccggacccgtaacgggccgttcccgcccccgttcgggtacccaccgttccgttcgtttcccccccg

SEQ ID NO: 324093 - DNA, 538 bp, Homo sapiens
  misc_feature: GZ8MTXP02HIUW6.52.36.D03.1.454.CMB.2.raw
  modified_base (242)..(242): a, c, t, g, unknown or other
  misc_feature (242)..(242): n is a, c, g, or t
  modified_base (286)..(286): a, c, t, g, unknown or other
  misc_feature (286)..(286): n is a, c, g, or t
  modified_base (368)..(368): a, c, t, g, unknown or other
  misc_feature (368)..(368): n is a, c, g, or t
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattntgctgactggtaccagcagaagccagccaagcccctgagttggngaataataacgaaaatagtagagcgactaccccgtggggactccctagacccgtattctacgtgggtccacctcaagggaanaccgacccaccctagaccatacaaacgacgggtccgactagaaacgacgaggctagacctattactgtcttgtcgttggggatggagacacagttggtgttcggcggaggacaagcttgacccgtctactcgcacgccgaaggctccgccccctggtccaccttctcccg

SEQ ID NO: 324094 - DNA, 593 bp, Homo sapiens
  misc_feature: GZ8MTXP02JRMW8.52.36.D03.1.454.CMB.2.raw
  modified_base (244)..(244): a, c, t, g, unknown or other
  misc_feature (244)..(244): n is a, c, g, or t
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcggtcgtccccaggacagacagccaggatcacctgctctggagatgtacgtaggggaaaattntgctgactggtaccagcagaagccaggccaacgcccctagacgttggtagatagtaacgaaaatgtagagcgctaccgtgggactccctgaccccgtattctcgtcgggtccacctcgagggaacacggacccaccgtacgaccataccaacgacgggtaccgacgtaggaacgacgagcgtagaactatactgtacgttgtacggtaggggataggacgacgacgtagttgggtgttcgggacgggaacggacgaacggccgtacggacccgtccgtacggtaccgacgacccgacgccgtccgacccccgtcggtcctaccgtccgttcccggttacccctcccccg

SEQ ID NO: 324095 - DNA, 588 bp, Homo sapiens
  misc_feature: GZ8MTXP02IWRP5.52.36.D03.1.454.CMB.2.raw
  modified_base (243)..(243): a, c, t, g, unknown or other
  misc_feature (243)..(243): n is a, c, g, or t
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggactcacctgctctggagatgtactaggggaaaattngctgactggtaccagcagaagccgagcccaagcccctgagttgtgataatacgaaaatgtagagcgacctacccgtgggaactccccgtgacccgtattcgctgggtcccacgtcgaagggaacaccgacccaccctgaccatccgaaacgcgggtccgataggaagacgagctgactagttactgctttagtcgtggggtactggaacggaccagtagttggtacggttcgggagggtacggggaaccaacggtctacggacccgtacgtaacggtccaacggccccaacggggtcctacccggcccccgttacgggcctacccttcggttaccgtttcccccc

SEQ ID NO: 324096 - DNA, 634 bp, Homo sapiens
  misc_feature: GZ8MTXP02JLRJ7.52.36.D03.1.454.CMB.2.raw
  modified_base (181)..(181): a, c, t, g, unknown or other
  misc_feature (181)..(181): n is a, c, g, or t
  modified_base (203)..(203): a, c, t, g, unknown or other
  misc_feature (203)..(203): n is a, c, g, or t
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagccttccctcggtntcagtcgtccccaggacagacngccaggatcacctgctcgtggagatgtaacgtaggggtaaaattatagctagactggtaccagcagaacgccaggaccaacgccccgtgacggtttggagataagtaacgaaaagtagtgacgcgctaccgtggactccgtacgaccgtattctcgtcggtaccacctcgaagggaacaccggacccacccgtacgaacctactacaacgtacgggtaccgaccgtagaaacgacgtacggctacgactactactgtcttgtcgtagggataggacgactagtaggttacggtcggtacggggtacgggacgggtaaccgtaaacgggcccttaggtacccccgttacgtaccgttaccgaacgtaccccgaacggtccgtacccgtacccccgtcgggtacccacgtttcccgtaccccggtttcccccg

SEQ ID NO: 324097 - DNA, 814 bp, Homo sapiens
  misc_feature: GZ8MTXP02G2FIQ.52.36.D03.1.454.CMB.2.raw
tcagcgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagtccttcccgtcggtgtcagtcgtccccaggacagacagccaggatccacctgctcgtggagtatgtaacgtaaggggtaaaattgtgctgacttggaccagacgaagacgaccgagacccgaacgccccgtggacggttggtagtaataagtaaacgtaaaagtaggtaggacggtccgtaccgtaacccgtggggtaccttaccccgtacgtaacccgtactttccgtccggttacggggtaccccaacccgttacggaaacgggggaaaccgaacccgtaaccccaccccgtaacggaccctaacaacccgtaaaacggacccgggggtacccgtaacggtaaacggaaaacggtaccgggacggttacgtaaccggtaactttaaaccgttaccgttggttacgtttcggggttacgggttagggggtaacgttacggggtaaagacccgttaaggttaagggtttacgggggtttcgggttaacgggggtaccgggggaaaccggtaaaccgtaaaacggtccgggttaaccgggtacccccgttaccggtaaccgggtaccaccggtacccggtaacggtcccgtccccgggtccccgttaccggtcctacccgttccggtttaccccgtttaaccccccg

SEQ ID NO: 324098 - DNA, 603 bp, Homo sapiens
  misc_feature: GZ8MTXP01CM5J5.39.48.E04.1.454.CMB.2.raw
  modified_base (376)..(376): a, c, t, g, unknown or other
  misc_feature (376)..(376): n is a, c, g, or t
tcagtcgcactagtcacgaccggtgctcgatttagagagcgtcacagagagaaggggtctgagagaggagcccagccctgggattttcaggtgttttcatttggtgatcaggactgaacagagagaactcaccatggagtttgggctgagcgtggtcttttcttgtggctaattttaaaaggtgtcagtgtgaggtgcagctgttggagtcgtgggggagcttggtacagccgtggggggtccctgacgactctcctgtgcagcctctggattcaccttagcagctatgccatgagcgtgggtcccgcgaggctccgagggggaagggggctgggagtgggtctcgagtccttattaggtggtagtggtagggtancaactatacgtacgcagtacctcggtagaacggggtcccggttacaccgtaatcctaccgagacgaaccaaattacccaaagaacacgtctgtaatctagacaaagtagaacagccctaggacggacgcccggaaggtaccgacgggtacccttaaattacgttaccgttaggttcgaacggtaaaattcggaaagcccggtacgttagggaacgttaagttccggg

SEQ ID NO: 324099 - DNA, 638 bp, Homo sapiens
  misc_feature: GZ8MTXP01DID85.39.48.E04.1.454.CMB.2.raw
  modified_base (185)..(185): a, c, t, g, unknown or other
  misc_feature (185)..(185): n is a, c, g, or t
  modified_base (444)..(444): a, c, t, g, unknown or other
  misc_feature (444)..(444): n is a, c, g, or t
tcagtcgcactagtcacgaccggtgctcgatttagagagcgtcacagagagaaggggtctgagagaggagcccagccctgggattttcaggtgttttcatttggtgatcaggactgaacagagagaactcaccatggagtttgggctgagctggtctttttcttgtggcttaattttaaaaggtntccagtgtgaggtgcagctggttggagtcgtgggggagcgttggtacaggccgtgggggtccctgagactctcctgtgcagcctcgtggtattcacctttagcagctatcgccatgagcgtggtcccgcgaggccgtccggaagggggaacggggtcgtgggtaggtcgggtcctgacgtaccttagttaggtggtagtgggtaagtagcaactactacgtacgcagcgtcccggtaggaacggggtccgttacacctnttaccctaccgaaggacaaacctaaacttaccgaaaacggaacaacccggttgttagtactacgtacgaaactaaagtacgaaacgacgacgtaaggacggaccggacgggaacggaaccgttacggtaccttaagttaacgttacgttagttacgaacgtaaagtagaacgacgtagttagtaacgttcgtcg

SEQ ID NO: 324100 - DNA, 650 bp, Homo sapiens
  misc_feature: GZ8MTXP01DES26.39.48.E04.1.454.CMB.2.raw
tcagtcgcactagtcacgaccggtgctcgatttagagagcgtcacagagagaaggggtctgagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgttggagtcgtgggggaggcttggtacagccgtgggggtccctgagactctcctgtgcagcctctggacttcacctttagcagctatgccatgagcgtggtccgcaggctaccgagggacgggctggaggtgggtctcgagtccgtattaggtggttagtgggtaggtagcaactattaaaccgtacgaccaacgtacgtacccggtaggaaacggggtccccggttacaacccgtattacccgtaccgaagggaactaacctaaacttaaccccgaaagtaaacccgtacccggactttaggttaacttacgtacgaacctaaaagtcgaaacaacggtccctaggacgacggacccggaacgacgaccggtccgttaattacgttacgttggttacgaccgtaaagtttaaggaacgtccgaagttaggtaacgttgttccggg

SEQ ID NO: 324101 - DNA, 526 bp, Homo sapiens
  misc_feature: GZ8MTXP02HWTZ9.39.48.E04.1.454.CMB.2.raw
  modified_base (417)..(417): a, c, t, g, unknown or other
  misc_feature (417)..(417): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
tcagtcgcactagtcacgaccggtgctcgatttagagagcgtcacagagagaaggggtctgagagaggagcccagccctgggattttcaggtgttttcatttggtgatcaggactgaacagagagaactcaccatggagtttgggctgagcgtggtcgttttctaggtggctaattttaaaaggtgtccagtgtgaggtgcagctgttggagtcgtgggggagcttggtacagccgtggggggtccctgagtactctcctgtgcagcctctggattcacctttagcagctatgccatgagcgtcgggcccgccaggctccgaggggaaggggctgggagtggggtctcgagcctagttagtggtagtggtggtagcacatactacgcagactcgtagaggccgttcacatctcaganacaactaccaanacgactntntatcananaananacacncagagacgacgacgacgacgacgtactactacgtacgtagagtaagtagacgacgagtacgtagtagtcg

SEQ ID NO: 324102 - DNA, 573 bp, Homo sapiens
  misc_feature: GZ8MTXP02G16ZK.39.48.E04.1.454.CMB.2.raw
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
tcagtcgcactagtcacgaccggtgctcgatttagagagcgtcacagagagaaggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacagccgtgggggtccctgagactctcctgtgcagcctctggattcacttagcagctatgccatgagctgggtccgccaggcctccgaggggaggggcgtggaggtgggtctcgagccttagttagtggtaggtggtggtagcacatacgtacgcagacctccggtagaacgggtcccggttacaccgtatcctaccagtagaactaactaccgaaagaaacncgctgtatctagacaaatgaaaccngcctaggacgacgcccggaaggaccgacgggaccgttaattaacttacgtagtacgaacgtaaaagttggaaacggtccgaagtcggtacgtaagtcgg

SEQ ID NO: 324103 - DNA, 557 bp, Homo sapiens
  misc_feature: GZ8MTXP02G0QG5.39.48.E04.1.454.CMB.2.raw
  modified_base (429)..(429): a, c, t, g, unknown or other
  misc_feature (429)..(429): n is a, c, g, or t
  modified_base (513)..(513): a, c, t, g, unknown or other
  misc_feature (513)..(513): n is a, c, g, or t
tcagtcgcactagtcacgaccggtgctcgatttagagagcgtcacagagagaaggggtctgagagaggagcccagccctgggattttcaggtgttttcatttggtgatcaggactgaacagagagaactcaccatggagtttgggctgagctggcttttctgtggctattttaaaaggtgtccagtgtgaggtgcagctgttggagtcgtgggggagcttggtacagccgtgggggtccctgagactctcctgtgcagcctctggattcacctttagcagctatgccatgagctgggtccgccaggctcgaggggagggctggagtgggtctcgagcctagttagtggtagtggtggtagcacgatactacgcagactccgtagaacggtccggttcacgatcctaccagacgacaataccaaagaacncggctagtatcgtagaccaaatcgaaacagcctaggaacgacgacccggaaggacccgacgggacccgttaatacgttaaccgngttacgaacgtaaagttggaaacggtcaacgtagacgtagtcgg

SEQ ID NO: 324104 - DNA, 536 bp, Homo sapiens
  misc_feature: GZ8MTXP02J0H77.39.48.E04.1.454.CMB.2.raw
  modified_base (422)..(422): a, c, t, g, unknown or other
  misc_feature (422)..(422): n is a, c, g, or t
  modified_base (470)..(470): a, c, t, g, unknown or other
  misc_feature (470)..(470): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
  modified_base (534)..(534): a, c, t, g, unknown or other
  misc_feature (534)..(534): n is a, c, g, or t
tcagtcgcactagtcacgaccggtgctcgatttagagagcgtcacagagagaaggggtctgagagaggagcccagccctgggattttcaggtgttttcatttggtgatcaggactgaacagagagaactcaccatggagtttgggctgagcgtgtcttttctaggtggctaattttaaaaggtgtccagtgtgaggtgcagctgttggagtcgtgggggagcttggtacagccgtgggggtccctgagactctcctgtgcagcctctggattcacctttagcagctatgccatgagcgtgggtccgccaggctccgaggggaaggggctgggagtggggtctcgagtcctagttagtggtagtgggtggtagcacatactacgcagactccggtagaacggggtcccggttcaccgattccnccagacgaacaattaccaaagaacacgctgtatctgacaaatgaaacngccagagacgccgaggaccgacggccgtaatnttacngtacgagaagttcgaagcgatgaggtncg

SEQ ID NO: 324105 - DNA, 586 bp, Homo sapiens
  misc_feature: GZ8MTXP02HR07R.39.48.E04.1.454.CMB.2.raw
  modified_base (427)..(427): a, c, t, g, unknown or other
  misc_feature (427)..(427): n is a, c, g, or t
tcagtcgcactagtcacgaccggtgctcgatttagagagcgtcacagagagaaggggtctgagagaggagcccagccctgggattttcaggtgttttcatttggtgatcaggactgaacagagagaactcaccatggagtttgggctgagctggcttttcttgtggctattttaaaaggtgtccagtgtgaggtgcagctgttggagtcgtgggggagcttggtacagccgtgggggtccctgagactctcctgtgcagcctcgtggattcactttagcagctatcgccatgagcgtcgggtcccgccgaggctccggaggggaaggggctgggaggtggggtctcgagtcctagttaggtgggtaggttgggtggtagcacatacctacgcaacgacctccggaggaacgggtcccggttacaccngtcctaccagacgaactaattaccaaagaaccgacgtctagttatctagacaaatacgaactagcctaggacgacgacccggaacgaccgaccggtaccgttaaatacgttacgtaggtagacgtaaagttaggaaacgtcgaatggtagtacgtacgg

SEQ ID NO: 324106 - DNA, 518 bp, Homo sapiens
  misc_feature: GZ8MTXP02JFNA9.39.48.E04.1.454.CMB.2.raw
  modified_base (298)..(298): a, c, t, g, unknown or other
  misc_feature (298)..(298): n is a, c, g, or t
  modified_base (392)..(392): a, c, t, g, unknown or other
  misc_feature (392)..(392): n is a, c, g, or t
tcagtcgcactagtcacgaccggtgctcgatttagagagcgtcacagagagaaggggtctgagagaggagcccagccctgggattttcaggtgttttcatttggtgatcaggactgaacagagagaactcaccatggagtttgggctgagctggcttttctgtggctattttaaaaggtgtccagtgtgaggtgcagctgttggagtctgggggagcttggtacagcctgggggtccctgagactctcctgtgcagcctctggatcacctttagcagctatgccatgagctgggtccnccaggctccgaggggaaggggctggagtggggtctcgagcctattagtgtagtggtggtagcgacatactacgcagactccgtgaaggccgttnacatctccagagacaattaccaagaacacgctgtatctgacaaatgaacagcctgagagcccgaggacacggccgtaatacttacgtcgtgacgaaagttgaaacgccggattaggacgtagtcgg

SEQ ID NO: 324107 - DNA, 553 bp, Homo sapiens
  misc_feature: GZ8MTXP02GEXWA.39.48.E04.1.454.CMB.2.raw
  modified_base (382)..(382): a, c, t, g, unknown or other
  misc_feature (382)..(382): n is a, c, g, or t
  modified_base (456)..(456): a, c, t, g, unknown or other
  misc_feature (456)..(456): n is a, c, g, or t
  modified_base (481)..(481): a, c, t, g, unknown or other
  misc_feature (481)..(481): n is a, c, g, or t
tcagtcgcactagtcacgaccggtgctcgatttagagagcgtcacagagagaaggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacagccgtgggggtccctgagactctcctgtgcagcctctggattcacctttagcagctatgccatgagcgtgggtcccgccgaggcctccgaggggaaggggctggggaggtggggtctcgagccttagttagtgggtaggtgggtggtagccanagtacgtacgcagactccgtaggaacgggcccgttcaccgatcctaccagagaactaacttaccaaagaaaccncgctgtatctagacaaagtgaaacngcctagagagccgaggacacggacgtaatactacgtgacgacgaaagttgaaagccgtataggactagtcgg

SEQ ID NO: 324108 - DNA, 594 bp, Homo sapiens
  misc_feature: GZ8MTXP02IT7W2.39.48.E04.1.454.CMB.2.raw
  modified_base (267)..(267): a, c, t, g, unknown or other
  misc_feature (267)..(267): n is a, c, g, or t
  modified_base (391)..(391): a, c, t, g, unknown or other
  misc_feature (391)..(391): n is a, c, g, or t
  modified_base (567)..(567): a, c, t, g, unknown or other
  misc_feature (567)..(567): n is a, c, g, or t
tcagtcgcactagtcacgaccggtgctcgatttagagagcgtcacagagagaaggggtctgagagaggagcccagccctgggattttcaggtgttttcatttggtgatcaggactgaacagagagaactcaccatggagtttgggctgagctggtctttttcttgtggcttaattttaaaggtgtccagtgtgaggtgcagctgttggagtcgtgggggagcttggtacaggccgtgggggtccctgagctctcctgtgcacgcctntggacttctaccttagcagctatcgccatgacgcgtcggtcccgccgaggcctaccggaggggaacggggcgtagggacggtgggtctacgagtccgttagttaggttgggtagtggtaggtancgatataccgtagccagaccgttcggaggaaccggtccgttacacgacttccacgaacgaacgaactaacgtaccaaacgaactaacgtctagtacttaccagaacctaaaagtcgaacgtaacgccgtaagacgacgtaccggacgacgacggtacctaatacgttcagaacganaaagtgaagtcggatagtacgtatcgg

SEQ ID NO: 324109 - DNA, 600 bp, Homo sapiens
  misc_feature: GZ8MTXP02I3WP5.39.48.E04.1.454.CMB.2.raw
  modified_base (384)..(384): a, c, t, g, unknown or other
  misc_feature (384)..(384): n is a, c, g, or t
tcagtcgcactagtcacgaccggtgctcgatttagagagcgtcacagagagaaggggtctgagagaggagcccagccctgggattttcaggtgttttcatttggtgatcaggactgaacagagagaactcaccatggagtttgggctgagctggctttttctgtggctattttaaaaggtgtccagtgtgaggtgcagctgttggagtcgtgggggaggcttggtacagccgtgggggtccctgagactctcctgtgcagcctctggattcactttagcagctatgccatgagcgtgggtcccgccaggcctccgaggggaacggggcgtagggagtgggtctcgagccttagttagtggtagtggtgtagcacatacgtcganacgacctcgtagaacgggtcccggttacacctagtcctaccgagaacgactaaattacccgaaaagtaaccacggtactaggtaactctaggaacctaaagtcggaaacacgccgtagaaggacgaccgggaaggtacccgacgggacccgttattaacgttacgtagttacgaacgtaaaagttcggaaaacggcgtaacgtaggacgtagtcgg

SEQ ID NO: 324110 - DNA, 501 bp, Homo sapiens
  misc_feature: GZ8MTXP01DK1YH.51.39.D06.1.454.CMB.2.raw
  modified_base (357)..(357): a, c, t, g, unknown or other
  misc_feature (357)..(357): n is a, c, g, or t
  modified_base (406)..(406): a, c, t, g, unknown or other
  misc_feature (406)..(406): n is a, c, g, or t
  modified_base (449)..(449): a, c, t, g, unknown or other
  misc_feature (449)..(449): n is a, c, g, or t
tcagcgatcgtatacacgaccggtgctcgatttagtgacatctcgcagttctttgggcacgaccggtgctcgatttagtgacatctcgcagttctttggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattctattggtaccaacagaagccaggccaggcccctgtcgttgttgattatataaagacagtgaagaggccttnagggatccctgagcgattctctggctccacctcagggacactggtcacnttgaccatcagtgagtccaggcagaagcgagctgctaatttcngtcaatcttcagcttcaagttggtaacttatgttcttcggaacgttaacggg

SEQ ID NO: 324111 - DNA, 486 bp, Homo sapiens
  misc_feature: GZ8MTXP01C5C83.51.39.D06.1.454.CMB.2.raw
  modified_base (260)..(260): a, c, t, g, unknown or other
  misc_feature (260)..(260): n is a, c, g, or t
  modified_base (341)..(341): a, c, t, g, unknown or other
  misc_feature (341)..(341): n is a, c, g, or t
  modified_base (432)..(432): a, c, t, g, unknown or other
  misc_feature (432)..(432): n is a, c, g, or t
tcagcgatcgtatacacgaccggtgctcgatttagtgacatctcgcagttctttgggcacgaccggtgctcgatttagtgacatctcgcagttcttggggtggtccaggaggcagaactctgggtgtctcaccatggcctggatccctctacttctccccctctcactctctgcacaggctctgagcctcctatgtgctgacacagccacctcggtgtccgtgtccccaggacagacggccaggatcacctgctctgganatgcattgccaaccatattctatgtacaacagagcaggcaggccctgtgtgttgatatataaagacagtgaagaggccttnagggatccctgacgcgattctctggctcgactcaggacactggtcacattagaccatcagtgagtccagcagaagcgagctgactaattcngtacaatctacagttcttcaagtgtaacttagtgttcttcggaacgttaacggg

SEQ ID NO: 324112 - DNA, 508 bp, Homo sapiens
  misc_feature: GZ8MTXP01CLOKH.51.39.D06.1.454.CMB.2.raw
  modified_base (448)..(448): a, c, t, g, unknown or other
  misc_feature (448)..(448): n is a, c, g, or t
  modified_base (470)..(470): a, c, t, g, unknown or other
  misc_feature (470)..(470): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttatggtaccaacagaagccaggcccaggcccctgtcgttgttgatatataaagacagtgaagaggccttcagggatccctgagcgattctctggctccacctcgagggacactggtcacattgaccatcagtggagtccaggcagagacgaggctgatnttcttgtcaattctcagcgttnaagtggtaaccttagtcgttacttcggaacgttcgggg

SEQ ID NO: 324113 - DNA, 585 bp, Homo sapiens
  misc_feature: GZ8MTXP01BCHIQ.51.39.D06.1.454.CMB.2.raw
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggactcacctgctctggagatgcattcgccaacccactattcttattggtaccaacagaagccaggccaggcccctgtgttgttgatactataaagcagtgaagagccttgagggatccctgagcgattctcgtggcctccacctcgaagggaccacgtcggtcaactattagaccctagtccgaggttgacgtccgaggccaagaaagaccgaagggtcttacggaactttaatttccttaggttacaaactttcgtttacgaacggttccgttccgtaaggtttggttaacctttagttcgttaccgtttaaccggttaaaccgttaaccggggg

SEQ ID NO: 324114 - DNA, 626 bp, Homo sapiens
  misc_feature: GZ8MTXP01D2MUY.51.39.D06.1.454.CMB.2.raw
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctctcactctctgcacaggctctgaggcctcctatgtgctgacacagccacccgtggtgtcccgtgtccccaggacaggacgccaggatcacctgctctggagatgcattcgccaaccccacttattcttattcggtaaccaacagaagccaggcccaggcccctgtcgttgtgatatataaagacagtgaagaggtccttgagggtactccctagacgcgtacttctcgtcggcctccaccttcgaacgggacacgtacggcacattacgaccagtacgaggttaggacgtacccgaaggcgaaggaaacgacggaggtacgttacggaaactttaacgtttcgttggttaacccttaaattaccgtttacgaacggttaaccgttaccggtaagggtttacgggtttaactttaacggttcggtttaccggtttaaccgggttaacgtttaaacccggggg

SEQ ID NO: 324115 - DNA, 620 bp, Homo sapiens
  misc_feature: GZ8MTXP01EKBJV.51.39.D06.1.454.CMB.2.raw
  modified_base (227)..(227): a, c, t, g, unknown or other
  misc_feature (227)..(227): n is a, c, g, or t
tcagcgatcgtatacacgaccggtgctcgatttagtgacatctcgcagttctttgggggctgtgggtccaggaggcagaactctgggtgtctcaccatggcctggatccctctacttcctccccctcctcactctctgcacaggctctgaggcctcctatgtgctgacacagccaccctcggtgtccgtgtccccaggacagacggccaggatcacctgctctgganatgctattcgacccaaaccctacttattccttattcggtaaccaaacagaacgccaggcccacggcccctgtcgttgttagatataataaagacagtgagacgtccttgaggactccgtgacgcgtattctcgtcggcctacccacctcgagggacctacgtcggtacactattcgacctatcgaggtggacgtcccgaagggacaaggaacgacggagctagtaccttatttctgtactaacttcttacgacgtaccgttagtaggttacggttactttagtcggttaacgttacggaacggtcgggaaccgtaaggttcccaccggttccgttaacgggtccaaccggaacccgaaacgggccccttaaacccgtaaccgttcgtaacccc

SEQ ID NO: 324116 - DNA, 508 bp, Homo sapiens
  misc_feature: GZ8MTXP01DD9G8.51.39.D06.1.454.CMB.2.raw
  modified_base (301)..(301): a, c, t, g, unknown or other
  misc_feature (301)..(301): n is a, c, g, or t
  modified_base (439)..(439): a, c, t, g, unknown or other
  misc_feature (439)..(439): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
  modified_base (473)..(473): a, c, t, g, unknown or other
  misc_feature (473)..(473): n is a, c, g, or t
  modified_base (488)..(488): a, c, t, g, unknown or other
  misc_feature (488)..(488): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctctcactctctgcacaggctctgaggcctcctatgtgctgacacagccaccctcggtgtccgtgtccccaggacagacgccaggatcactgctctggagatgcattgccaacccatatcttattgtaccaacagaanccagccagccctgtgttgtgatatataaagacagtgaagaggccttcgagggactaccctggacgcgattctctggctccaccttcgaagggaccactggtcactattgaccatcgagtggacgtccaggcaagaagngaggctgactaatttcngtacaatnttcagttcnctaagtgtaacttangttcttcggaacgtaacggg

SEQ ID NO: 324117 - DNA, 654 bp, Homo sapiens
  misc_feature: GZ8MTXP01A1UCO.51.39.D06.1.454.CMB.2.raw
  modified_base (271)..(271): a, c, t, g, unknown or other
  misc_feature (271)..(271): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttcctcccctctcactctctgcacaggctctgacggcctcctatgtgctgacacacgccctaccgtcggtcgtccgtcgtccccaggacaggacggcagactcacctgctctgganatgcattcgccaaccacttattcttattcggtaccaaacagaacgccaggcccaggcccctgtcgttgttagataactataaaagacaggtgaagacgccttacgagggactcccgtagacgtcgtacttctcgtcggccttcccgaaccgttcgaacggggacctaacgttcgggtacaacgtacgtttacgaaccagtaccgtaagggttcgggaacttacccggaagggccgaaaggaaacggaccggaagggtcctagggtaacctttaagttttccttaggttacaaacgtttccgttaacacggttacccgttacgtaagtttacgggtttaacttaacgttcggttccgttttaacgggaaacgtttaaccggggg

SEQ ID NO: 324118 - DNA, 540 bp, Homo sapiens
  misc_feature: GZ8MTXP01DX1WU.51.39.D06.1.454.CMB.2.raw
  modified_base (486)..(486): a, c, t, g, unknown or other
  misc_feature (486)..(486): n is a, c, g, or t
  modified_base (497)..(497): a, c, t, g, unknown or other
  misc_feature (497)..(497): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatcacctgctctggagatgcattgccaacccatattcttattcggtaccaacagaagccaggcccaggcccctgtgttgtgatatataaagacagtgaagaggtccttcgagggactcccgtgagcgtattctctggctccaccttcgacgggacacgtggtcacattacgacctatcaggttggacgtccgaggcagaaagcgaaggctgactaatttcttgtacttaattcttanacgttcttacnggtaggttaacttatcgttcgttaacggttaacgttaacgggg

SEQ ID NO: 324119 - DNA, 727 bp, Homo sapiens
  misc_feature: GZ8MTXP01DN14L.51.39.D06.1.454.CMB.2.raw
  modified_base (201)..(201): a, c, t, g, unknown or other
  misc_feature (201)..(201): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgngctgacacagcccaccctggtgtccgtcgaccccagggacagacggccaggatcacctgctcgtggagatgctattcgaccccaaaccctacttatttaccttagtttacggaaacccaaacaaggtaaacgccccgaacgggccccaacgggggtccccccttggttggtttagttaggaaattaacgtaaaattaaaaggaccgtaggttggaaaaacggtacgggtccccgtttagggaaagggggtaccctttacccccgtaggggaacggtaccgttaactttcccgttcgttcgggacctacccacccgttacggaacggggacctaacgttcgggactaacaacgtttcgaaccctagttcgaaggttacggacgtaccaagggacaaaggaaacggacgaagggtctacggtaactttaacgtttccttggttaaaccttaattccgttcgaacgttcgttacgtaaggttaggtttaactttagtcggttaccttaaccgggttaacggtaaccggg

SEQ ID NO: 324120 - DNA, 589 bp, Homo sapiens
  misc_feature: GZ8MTXP01CUU0W.51.39.D06.1.454.CMB.2.raw
  modified_base (262)..(262): a, c, t, g, unknown or other
  misc_feature (262)..(262): n is a, c, g, or t
  modified_base (434)..(434): a, c, t, g, unknown or other
  misc_feature (434)..(434): n is a, c, g, or t
tcagcgatcgtatacacgaccggtgctcgatttagtgacatctcgcagttctttgggggtgggtccaggaggcagaactctgggtgtctcaccatggcctggatccctctacttctcccctcctcactctctgcacaggctctgaggcctcctatgtgctgacacagccaccctcggtgtccgtgtcccccaggacagacggccaggatcacctgctctggagatgcattcgacccaaccattattcttattggtaaccaanagaagccaggccaggccctgtgttgtgatataataaagacagtagagaggcctttacgagggactcccgtgacgcgtattcctcgtgcctccacctcgagggcactgggtacactattcgacctatcagtaggacgtcgaaggcaaaggaacgacgaggctgacttatttcnggtactaattcttacgagtacgtcgtagttaggttaacttagtcgttcgttacggaacgttcgggaactaacggttccgtaaacccggttcttacgggttccacggtaaccccaaacggccccaaaccccagttccgtaaccttaaccgttcccg

SEQ ID NO: 324121 - DNA, 697 bp, Homo sapiens
  misc_feature: GZ8MTXP01ASP6C.51.39.D06.1.454.CMB.2.raw
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttcctccccctctcactctctgcacaggctctgacggcctcctatgtgctgacacagccacctggtgtcccgtgtccccaggacaggacggccaggactcacctgctctggagatgcattcgaccccaacccacttattcttattcggtaaccaaacagaaacgccgaaggcccaacggtcccccttgttcgttagttgaattaataataaaagactaagttaggaaaacggtacggtcccgttacgaaacgggggtaaccttccccgtaggtaacggcggttaaactttccgttcgtcggtacccttacccgaaccgtaccggtaaacgggggacctaccgtacgggttaccaacttagtttacggaaccccgtattaaccgtacggggttaggaacgttacccgaaggggaccaaacgggaaacgaccggaggtaccgtacggtacttaactttccgagttaccttaaagttcctacgttagaccgttacgtaagttcggttaacctttagtcggttacgtttcggaacgttaaccgggg

SEQ ID NO: 324122 - DNA, 515 bp, Homo sapiens
  misc_feature: GZ8MTXP01B1WQ5.51.39.D06.1.454.CMB.2.raw
  modified_base (505)..(505): a, c, t, g, unknown or other
  misc_feature (505)..(505): n is a, c, g, or t
tcagcgatcgtatacacgaccggtgctcgatttagtgacatctcgcagttctttgggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaacccatattcttattggtaccaacagaagccaggccaggcccctgtgttgttgatatataaagacagtgagaggccttcagggatccctgagccgattctctggctcccacctcagggacactggtcacattgaccatcagtggatccgaggcaaggaagacgaggctgacttatttctgtcaattcttcagacgtcagtggtacttatgtcttcggaactgggacctaaggtcaccgttcttaggtcacgcccaaggcccacccncttcgtaacc

SEQ ID NO: 324123 - DNA, 679 bp, Homo sapiens
  misc_feature: GZ8MTXP01AF2C2.51.39.D06.1.454.CMB.2.raw
  modified_base (336)..(336): a, c, t, g, unknown or other
  misc_feature (336)..(336): n is a, c, g, or t
tcagcgatcgtatacacgaccggtgctcgatttagtgacatctcgcagttctttgggcacgaccggtgctcgatttagtgacatctcgcagttctttggggtgggtccaggaggcagaactctgggtgtctcaccatggcctggatccctctacttctccccctcctcactctctgcacaggctctgacggcctcctatgtgctgacacagccacctcggtgtcctgtccccaggacagacgccaggatcacctgctctggagatgcattcgccaacccatattcttatggtaaccaacagaagccaggccacggcccctgtcgttgttgatatanaagacagtcgaagacggccttcgagggactacccgtggacgcggtacttcctacgtcggtacctcccgacccgttcgaaacggggacctacgttcgggtacctacgtaatttcggaacccattcccgaagggttacgggaacgttaccccggaaggccgaaacgggaaacggtaaccgggaacgggtcccgttagggttaaacctttaaacggttttccttacgggttaaccgaaactttccggttttaaccgacgggttaccgttacccgtaagggtttacgggttaaccttttaacgttcggtttaccggtttaaccgggttaaccggtttaacccggggg

SEQ ID NO: 324124 - DNA, 642 bp, Homo sapiens
  misc_feature: GZ8MTXP01AOQHB.51.39.D06.1.454.CMB.2.raw
  modified_base (270)..(270): a, c, t, g, unknown or other
  misc_feature (270)..(270): n is a, c, g, or t
  modified_base (358)..(358): a, c, t, g, unknown or other
  misc_feature (358)..(358): n is a, c, g, or t
tcagcgatcgtatacacgaccggtgctcgatttagtgacatctcgcagttctttgggcacgaccgtgctcgatttagtgacatctcgcagttctttggggtgggtccaggaggcagaactctgggtgtctcaccatggcctggatccctctacttctccccctcctcactctctgcacaggctctgaggcctcctatgtgctgacacagcccacccgtggtcgtcccgtgtccccaggacagaccggccaggactcaccctgctctgganatgctattcgacccaacccattattcttagttacgtaacaacagaacgcctaggccctacggcccttgttgtgttgatataataaganagtagagacgtcttgacgggtctccgtgagcgtacttctacgtcggctacccgtacctacggaacgggaacctacgtacggtaccaaccgtattacgaacccgtagtaacgtaggtacggacgtacccgagtacggaaagacgaacggtacggacttacgtaacttaacgtttcgttatacgttaacgttacctttacggaacgttcccggttagtaaccggtttgggtttaacctttaaggttcggttaccggttaaccgggttaaaccggtttaacccgggg

SEQ ID NO: 324125 - DNA, 689 bp, Homo sapiens
  misc_feature: GZ8MTXP01BR5V4.51.39.D06.1.454.CMB.2.raw
  modified_base (128)..(128): a, c, t, g, unknown or other
  misc_feature (128)..(128): n is a, c, g, or t
  modified_base (218)..(218): a, c, t, g, unknown or other
  misc_feature (218)..(218): n is a, c, g, or t
tcagcgatcgtatacacgaccggtgctcgatttagtgacatctcgcagttctttgggcacgaccggtgctcgatttagtgacatctcgcagttctttgggggtggtccaggaggcagaactctgggtntctcaccatggcctggatccctctacttctcccctctcactctctgcacaggctctgaggcctctatgtgctgacacacgccacctggtntccgtgtccccaggacagacggccaggactcacctgctctggacgatcgcattcgacccaaccctattatttcttagttacggtaaccaactagaacgccaggcccaaggtcccctagttgtttgtcgaatactaataaagactagtgaaagacgtccttgaagggactcccgtagacgacgtattctcgtggtccctaccgaccttacgaacgggtaacctacgttacgggtacctaaaccgtagtttaccggaaaccctaacggtttacgaaacggggtttacggaaacggttcccgaaaacggggtccctaaaagggaaaacggttaccggtaacggggtaccttacgggtacctttaaacgttttcccgttaaggttaccttaaaggttccctttacaaacgggttccttacgtaagtacggttaactttaacgtcggttacgttaaccggttaacgttaacccggg

SEQ ID NO: 324126 - DNA, 724 bp, Homo sapiens
  misc_feature: GZ8MTXP01C57MO.51.39.D06.1.454.CMB.2.raw
  modified_base (128)..(128): a, c, t, g, unknown or other
  misc_feature (128)..(128): n is a, c, g, or t
  modified_base (151)..(151): a, c, t, g, unknown or other
  misc_feature (151)..(151): n is a, c, g, or t
tcagcgatcgtatacacgaccggtgctcgatttagtgacatctcgcagttctttgggcacgaccggtgctcgatttagtgacatctcgcagttctttgggggtggtccaggaggcagaactctgggtntctcaccatggcctggatccctntacttctccccctctcactctctgcacaggctctgagcctctatgtgctgacacagccaccctggtcgtccgtgtccccaggacaggaccgccaggactcacctgctctggagatgcattgccaacccatattcttatggtaccaacagaagcaggccagcccctgtcgttgtgatatataaagcagtgaagagcttacgagggtaactcccgtagacgtacgtactttccgttcgtcgggaccttcccgaaccgttaccggaaacggggtaaccctaaacgttcgggttaccgaaactacgtttaaccgggaaccccttaaggggttaccccgtaagggtttacggggaaccgggttacccgaaacggggtacccgtaaagggaaaaaccggtaacccggggaaaagggggtcccttaacgggttaaacccttttaaacgttttcccgtttacggttaacccgttaaacgttttaccttacgttaaaccgggttaacgttacccgtaaggtttacgggttaacctttagtacggtttaccgtttaaccgggttaacggtttaaacccggggg

SEQ ID NO: 324127 - DNA, 636 bp, Homo sapiens
  misc_feature: GZ8MTXP01BJAEM.51.39.D06.1.454.CMB.2.raw
  modified_base (151)..(151): a, c, t, g, unknown or other
  misc_feature (151)..(151): n is a, c, g, or t
tcagcgatcgtatacacgaccggtgctcgatttagtgacatctcgcagttctttgggcacgaccggtgctcgatttagtgacatctcgcagttctttgggggtggtccaggaggcagaactctgggtgtctcaccatggcctggatccctntacttctccccctctcactctctgcacaggctctgaggcctcctatgtgctgacacacgccaccctggtgtcccgtgtccccagggacaggaccggccagggactcacctgctcgtggagatgcattcgcccaaaccctactatttcttagttacggtaccaacagaacgccaggcccaggtcccctgttgttgtgataataataaagacgtagtagaaaggacgccttagacgggtactcccgtagtacgcgtacttctcgtcggtctcccaccgttcgaacgggactaacgtcggtacactattacgaacctacgtacgtaaggtggacggtaccgaggacgaacggaaacggacggtaagggtacctacggtaactttaacgtttcttacggttacttaaacgttcctttaacgacggttcgttaccgtaaggtttaggttaaccttagttcggttaccgttcgggttaacgttaaccgggg

SEQ ID NO: 324128 - DNA, 646 bp, Homo sapiens
  misc_feature: GZ8MTXP01A3J78.51.39.D06.1.454.CMB.2.raw
  modified_base (270)..(270): a, c, t, g, unknown or other
  misc_feature (270)..(270): n is a, c, g, or t
tcagcgatcgtatacacgaccggtgctcgatttagtgacatctcgcagttctttgggcacgaccggtgctcgatttagtgacatctcgcagttctttggggggtgggtccaggaggcagaactctgggtgtctcaccatggcctggatccctctacttctccccctctcactctctgcacaggctctgaggcctctatgtgctgacacagcccacctcggtgtccgtgtacccaggacaggacggccaggactcacctgctcgtggatancgctattcgccaaacctacttattcttattacgtaaccaacagaacgccaggccacggtccttagtcgttgtgaatataagtaaagacagtgaaacgtacgtccttagagggtactccgtggacgtcgtacttccgtcgtcgtacctccacgtacgaacggggtacctacgtacggtacacgtacgttacgaacctagtacgtagggtacgggtaccgtaaccggaggaccgtaaaggaacggtacggtaacgtcgttaacggtacttaacgttttcgttacgttacttaaacgttcgtaacgttaacgttccgttagtaacggtttaggttaactttcgtacggtttaccgttaacggttaacggttaacccggg

SEQ ID NO: 324129 - DNA, 509 bp, Homo sapiens
  misc_feature: GZ8MTXP02GABBM.51.39.D06.1.454.CMB.2.raw
  modified_base (378)..(378): a, c, t, g, unknown or other
  misc_feature (378)..(378): n is a, c, g, or t
  modified_base (450)..(450): a, c, t, g, unknown or other
  misc_feature (450)..(450): n is a, c, g, or t
  modified_base (480)..(480): a, c, t, g, unknown or other
  misc_feature (480)..(480): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccaacagaagccaggccaggcccctgtgtgtgatatataaagcagtgagaggccttcgagggtactcccgtgagcgattctntcggctccaccttcgacggggacacgtcggtacacattcgaccatcagtggagtccaggcagaagacgagcngactagttctgtactaatcttcagtccgtnaagtgtacttatgtcttacggactacggg

SEQ ID NO: 324130 - DNA, 526 bp, Homo sapiens
  misc_feature: GZ8MTXP02G2575.51.39.D06.1.454.CMB.2.raw
tcagcgatcgtatacacgaccggtgctcgatttagtgacatctcgcagttctttgggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccactattcttattggtaccaacagaagccagccaggcccctgtgttgttgatatataaagacagtgagaggccttcagggatccctgagccgattctctggctccactcagggacacgtggtcacattcgacccatcagtggagtccaggcagaagacgagctgactagttctgtcaattcttacagacgtcagtgtacttatgttcttacggaacttcgggactaaacggtcctaccgtccgtaaggtcacgaccccgaacggacccaaccccacgtcgtaccc

SEQ ID NO: 324131 - DNA, 490 bp, Homo sapiens
  misc_feature: GZ8MTXP02JZ5PV.51.39.D06.1.454.CMB.2.raw
  modified_base (436)..(437): a, c, t, g, unknown or other
  misc_feature (436)..(437): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattctattggtaccaacagaagccaggccaggcccctgtcgtgttgatatataaaagacaagtgagaggccttcagggatccctgagcgatctctggctccactcagggacactggtcacattgaccatcagtgagtcagcagaagacgaggnngatattntntacatactacacgacgacaagtgtactatgtcgtacgtacgtcg

SEQ ID NO: 324132 - DNA, 488 bp, Homo sapiens
  misc_feature: GZ8MTXP02GQZUQ.51.39.D06.1.454.CMB.2.raw
  modified_base (264)..(264): a, c, t, g, unknown or other
  misc_feature (264)..(264): n is a, c, g, or t
  modified_base (352)..(352): a, c, t, g, unknown or other
  misc_feature (352)..(352): n is a, c, g, or t
  modified_base (441)..(441): a, c, t, g, unknown or other
  misc_feature (441)..(441): n is a, c, g, or t
tcagcgatcgtatacacgaccggtgctcgatttagtgacatctcgcagttctttgggcacgaccggtgctcgatttagtgacatctcgcagttctttggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatcacctgctctgganatgcattgccaaccatattctattggtaccaacagaagccaggcccaggcccctgtgttgtgatatataaagacagtgagaggccttnagggatccctgagcgattctctggctccacctcagggacactggtcacattgaccatcagtgagtccagcagagcgagctgactattcngtcaatcttcagtcgtcaagtgtacttatgtcttcggaacttacggg

SEQ ID NO: 324133 - DNA, 715 bp, Homo sapiens
  misc_feature: GZ8MTXP02IIRV9.51.39.D06.1.454.CMB.2.raw
tcagcgatcgtatacacgaccggtgctcgatttagtgacatctcgcagttctttgggggtgggtccaggaggcagaactctgggtgtctcaccatggcctggatccctctacttcctcccctcctcactctctgcacaggctctgaggcctcctatgtgctgacacagccaccctcggtgtccgtgtccccaggacagacggccaggatcacctgctctggagatgcattcgacccaaaccctacttattcttaattcggtaaccaacagaagccaggccacggccctgtgttgtgatataataaagacagtgagaggtcctttagagggtactcccgtagagcgtacttcctcgtcggcctccacctccgaagggcctacgttcggtaccaactacgttacgaaccctatacgtaggtaggacgtaccaacggggggggggggggacaaacgggaaacggaaacgggaacgggtacgtacgtaacgtttaacgttttaccgttacgttaccttaaactttacctttaccgtaacgtaaccgttaccgtaaggttacggttaacgtttaacgttacggtttaccgtttaccgggtaaaccggttacggggtaaaccggtaaacggttaccggtaacccgttaccgtacggtaccgtaaccggaacccgaaaccggaaccccgaaaccccgaacctaccgtaccgtaccgtacccg

SEQ ID NO: 324134 - DNA, 521 bp, Homo sapiens
  misc_feature: GZ8MTXP02IS09C.51.39.D06.1.454.CMB.2.raw
tcagcgatcgtatacacgaccggtgctcgatttagtgacatctcgcagttctttgggcacgaccggtgctcgatttagtgacatctcgcagttctttggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgtgatatataaagacagtgagagccttgaggactccctgacgcgtattctctggctccacctcgacgggacacgtggtcacattgaccatcagtggacgtccagcagagacgaggctgacttattctgtacaaattcttaccagtacgtactaaggtcggttaacttagtagttacgtttacggaacgttacggg

SEQ ID NO: 324135 - DNA, 497 bp, Homo sapiens
  misc_feature: GZ8MTXP02JHN24.51.39.D06.1.454.CMB.2.raw
  modified_base (267)..(267): a, c, t, g, unknown or other
  misc_feature (267)..(267): n is a, c, g, or t
  modified_base (302)..(302): a, c, t, g, unknown or other
  misc_feature (302)..(302): n is a, c, g, or t
  modified_base (356)..(356): a, c, t, g, unknown or other
  misc_feature (356)..(356): n is a, c, g, or t
  modified_base (452)..(452): a, c, t, g, unknown or other
  misc_feature (452)..(452): n is a, c, g, or t
  modified_base (479)..(479): a, c, t, g, unknown or other
  misc_feature (479)..(479): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctgganatgcattgccaacccactattctattggtaccaanagaagccaggcccaggcccctgtgttgtgatatataaagacagtgagagccttnagggactccctgagcgattctctggctccacctcgagggaccacgtcggtcacattcgaccatcagtgagtccagcagagacgagctgactattcngtcaatctacacgcgtcaagtgtactntagtcttacggactacgg

SEQ ID NO: 324136 - DNA, 493 bp, Homo sapiens
  misc_feature: GZ8MTXP02GEV1J.51.39.D06.1.454.CMB.2.raw
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttnagggatccctgagcgattctntggctccacctcagggacacgtggtcacattgaccatcagtgagtcagcagagacgagctgactattctgtcaatctacagtactcaagtgtacttatgtcttcggacttacggg

SEQ ID NO: 324137 - DNA, 631 bp, Homo sapiens
  misc_feature: GZ8MTXP02FW1B0.51.39.D06.1.454.CMB.2.raw
  modified_base (210)..(210): a, c, t, g, unknown or other
  misc_feature (210)..(210): n is a, c, g, or t
  modified_base (275)..(275): a, c, t, g, unknown or other
  misc_feature (275)..(275): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacncgcccacccgtcggtcgtccgtcgtccccaggacaggaccggccaggactcacctgctcgtgganatgctattcgacccaaccctacttaatttctttattacggtaacccaacgaagaacgccgaggccccacggtccccttaggttcgttgttagtattaagttaagtaaaacgactaggtagaaggtacggtccttaggaagggtactcccgtgacgcgtattcctgtcggcctaccaccgtcgacggacctacgtcggtacactgttacgacctagtcgagtcggtacgacgacggacgtaaaggaacgacgggacgtcgtacgtactttaagtttccagtacctaaagttcctagaacgtaccgtacgtaaggttacggttacttacggttcgttacgtacgggacgttaaccggg

SEQ ID NO: 324138 - DNA, 700 bp, Homo sapiens
  misc_feature: GZ8MTXP02H2US0.51.39.D06.1.454.CMB.2.raw
  modified_base (260)..(260): a, c, t, g, unknown or other
  misc_feature (260)..(260): n is a, c, g, or t
  modified_base (346)..(346): a, c, t, g, unknown or other
  misc_feature (346)..(346): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctcccctctcactctctgcacaggctctgaggcctctatgtgctgacacagccacctggtgtccgtgtccccaggacagacgccaggatcacctgctctgganatgcattgccaacccatatcttattgtaccaacagaagccaggccaggcccctgtgttgtgatactataaagacagtgagagcttnagggtatcctgagcgattctgtggctccacccgtcaggggtaccacgtcgggtaccacgtatttacggaccctaagttccgtaaggttacgggtaggttaccccgaagggggtaccctaaagggggaaaacggtaaccgggaaacgggggtccctttacgggggtaaaacccttttaaacgtttttaccgttaggggttttaaacccctaaaacgttttcccgttttaaccggaacgggtttaaacccggttcccgttaaaaggggttttaccgggggtttaaaaccttttaaacggtttcggggtttaaccccggtttttaccggggtaaaacccggttttaaacccgggggg

SEQ ID NO: 324139 - DNA, 656 bp, Homo sapiens
  misc_feature: GZ8MTXP02FYPRN.51.39.D06.1.454.CMB.2.raw
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagcccaccctcggtcgtccgtcgtccccaggacagacggccaggactcaccctgctcgtggagatgcattcgcccaaaccctatatttcttattcggtaaccaacagaacgccaggcccacggccccttgtgttgtgatatataaagcagtgagaggtccttcgagggactcccgtagaggtctattctcgtcggtctacccacctcgaacgggactaacgtcggtaccaactacgtttagaacccaagttccgtaaggtacgggtacggtaccgaacgggacgaaacggaaacggaacggacggtaccgtacgggttaactttacgttttacgttacggtacctaaaacgtttccgttaccgtaacggtacgtttaccgtaacgggtttcggtttaaacctttaagttccggtttaacggttaccgggtaacgtttaaaccggggg

SEQ ID NO: 324140 - DNA, 582 bp, Homo sapiens
  misc_feature: GZ8MTXP02JKIL6.51.39.D06.1.454.CMB.2.raw
  modified_base (271)..(271): a, c, t, g, unknown or other
  misc_feature (271)..(271): n is a, c, g, or t
  modified_base (513)..(513): a, c, t, g, unknown or other
  misc_feature (513)..(513): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctctcactctctgcacaggctctgaggcctcctatgtgctgacacacgcccacccgtggtcgtccgtcgtccccaggacaggacggccaggactcacctgctctgganatgcattcgacccaaccattatttcttattcggtaaccaacagaacgccaggcccacggcccctggtcgttgtacgataactaataaagacagtgagacgtccttgaagggtctcccgtgacgcgtattcgtacgtcggtcctcccaccgtacgaacgggtaccacgttcggtacacgtagttacgacctatcgagtggacgtaccgaggacaaggaagacgaggctagtaacttctttcgngtacctaaagttctacgacgtacgtcgtaaggtacgttacttagtcgttacgttacggaacgttacggg

SEQ ID NO: 324141 - DNA, 615 bp, Homo sapiens
  misc_feature: GZ8MTXP02F9X3L.51.39.D06.1.454.CMB.2.raw
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctctcactctctgcacaggctctgaggcctcctatgtgctgacacagccaccctcggtgtccgtgtccccaggacagacgccaggntcactgctctgganatgcattcgccaaccactattcttattggtacctaacagaagccaggccaggcccctgtcgtgtgatatataagacagtgagagccttacgaggactcccgtgacgtcgtattcgtctcggctcccactcgacgggacacgtggtcaccgtattacggacctagtaccgtaggtcggtacggttaccgaacggaccgaaaggaaacggaacccggtagggtaccttacggtaacctttaacgttttcgttacggttcctaaaacttccgtttacgaaacggaccgtttcgtaaacggttcggtttaaactttacgttcgttacggtttaccgggtaaacgtttaaccggggg

SEQ ID NO: 324142 - DNA, 657 bp, Homo sapiens
  misc_feature: GZ8MTXP02HVK8O.51.39.D06.1.454.CMB.2.raw
  modified_base (270)..(270): a, c, t, g, unknown or other
  misc_feature (270)..(270): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttcctccccctctcactctctgcacaggctctgagcctctatgtgctgacacacgcccaccgtggtcgtccgtcgtccccgaggacagaccggccaggactcacctgctctgganatgacatcgacccaacctacttattcttagttacggtaaccaacgagtaacgccgtaacggcccaacggtccccttggttgtttacggttagtaagtaacttaagtaaaacggactaaggttgaaggacggtcctttacggagggaccttcccgtagacgtcgtattccgtcgtacggccctaccgacccgtcgaacgggtaccaccgtcggtaccacgtagttacgaaccctaagtcgtacggttacgggacgtacccgaggaccggaaaggaaacggaacggacggtccgtaagtaacgtttactttcgtacgtactaacgttcttacgacgttacgtacgaaggttacgttacgttatcgttaccggtacggtaacgtaccggg

SEQ ID NO: 324143 - DNA, 787 bp, Homo sapiens
  misc_feature: GZ8MTXP02FTZGS.51.39.D06.1.454.CMB.2.raw
  modified_base (251)..(251): a, c, t, g, unknown or other
  misc_feature (251)..(251): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggntcacctgctctggagatgctagttcgacccaaacccctactatttcttagtttacggtaacccaaacgaaggaaacgcccgaagggcccaacggggtcccccttggttcgtttaggtttaggaattaagttaaagtaaaaacgtaccgtaaaggttaggaacggtaacggggttcccctttacggaaacgggggtaccttacccccgtaggaacgtccggtaatttcccgtcgtaccgggtccttaccccgaacccgttcgaacgggggtaccctacggttacgggttaccaaaacctagtttaccgaacccctagttacccgtaaggttcgggtaacgtaccccgaaagggccgaaaggaaacggacggacgggtaccgttaacgggtaaccttttaacgttttcgtacggttacctaaaactttcccgtttacgtaaaccggtaccggtttacctaaggggtttacgggtttaaaccctttaaggtttcggtttaacccgtttaacccgggggtaacggtttaaaccccggggg

SEQ ID NO: 324144 - DNA, 644 bp, Homo sapiens
  misc_feature: GZ8MTXP02FIYVS.51.39.D06.1.454.CMB.2.raw
  modified_base (270)..(270): a, c, t, g, unknown or other
  misc_feature (270)..(270): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacacgcccaccctcggtgtccgtgtccccaggaccagaccggccaggatcacctgctctgganatgcattcgacccaacccatatttcttattcggtaaccaanagaacgccgaggcccacggccccttgtgtgtgatataataagacagtgagngtcctgagggtactcccgtagacgcgtattctcgtcggctacccaccgtcgaacggggacctacgtcggtaccaactacgtttacgaaccctaagtccgtaagttcggggaacgttaccgaaacgggaccaaaggaaaggaccggaaggtcgtacggtaactttaacgttttcgtacgttaacctaaactttcccgttacgtaacgtaccgttaacgtaaggtttacggttaacctttagttcggtttaccgttaaccgggtaaaccggtttaacccggggg

SEQ ID NO: 324145 - DNA, 591 bp, Homo sapiens
  misc_feature: GZ8MTXP02IVD7F.51.39.D06.1.454.CMB.2.raw
  modified_base (253)..(253): a, c, t, g, unknown or other
  misc_feature (253)..(253): n is a, c, g, or t
  modified_base (286)..(286): a, c, t, g, unknown or other
  misc_feature (286)..(286): n is a, c, g, or t
  modified_base (307)..(307): a, c, t, g, unknown or other
  misc_feature (307)..(307): n is a, c, g, or t
  modified_base (339)..(339): a, c, t, g, unknown or other
  misc_feature (339)..(339): n is a, c, g, or t
  modified_base (387)..(387): a, c, t, g, unknown or other
  misc_feature (387)..(387): n is a, c, g, or t
  modified_base (532)..(532): a, c, t, g, unknown or other
  misc_feature (532)..(532): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacacgccaccctcggtgtccgtcgtccccaggacagacggccaggntcacctgctctggagatgcattcgaccaacccnttattctattcggtaaccaanagaagccaggcccacggtcccctgtgttggtnactatataaagctagtgagcgcttgaggtactccgtgagcgtatttcncgtacggccttccgacccttgaacggaccgacgttggtaccacgtattacgaaccctagtccgaagttcggacgttaccgagacgaaggtaaacgacggaggtcctagacctttaagtttccgagttacctaaatttcccgttanaacggtacttacgaacgttaggttaaccttagtgttaccgtttacggaaacgtttcggg

SEQ ID NO: 324146 - DNA, 620 bp, Homo sapiens
  misc_feature: GZ8MTXP02HWGQY.51.39.D06.1.454.CMB.2.raw
  modified_base (129)..(129): a, c, t, g, unknown or other
  misc_feature (129)..(129): n is a, c, g, or t
  modified_base (267)..(267): a, c, t, g, unknown or other
  misc_feature (267)..(267): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtntctcaccatggcctggatccctctacttcctcccctctcactctctgcacaggctctgagcctctatgtgctgacacagccacccgtggtgtcccgtgtccccaggacaggaccggcaggactcacctgctcgtgganatgacattcgacccaacccactttatttacttaagtttcggtaaccaaacgaagaacgccgaggcccaggtcccctgtcgttgtgatataataaagacagtgagacgtccttagaggtactccgtagacgtcgattctcgtggtccctcgacccgtcgaacggactacgtggtaccactacgttacgaacctataccgtagttacggacgtacccgaggaccaaggaacgacggtacgcgtacgtaacttacgtttcgttacgtacctaaagttccgttacgaacgttaccgcgttaaggttacggttaactttacgttacgttacccgtttacggtaaaccgttaaccgggg

SEQ ID NO: 324147 - DNA, 514 bp, Homo sapiens
  misc_feature: GZ8MTXP02JTSR0.51.39.D06.1.454.CMB.2.raw
  modified_base (300)..(300): a, c, t, g, unknown or other
  misc_feature (300)..(300): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (446)..(446): a, c, t, g, unknown or other
  misc_feature (446)..(446): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctctcactctctgcacaggctctgaggcctcctatgtgctgacacagccaccctggtgtccgtgtccccaggacagacggccaggatcacctgctctggagatgccattgccaacccatattcttattggtaccaanagaagccaggccaggcccctgtgttgtgatatataaagcagtgagngccttgaggatccgngancgtattctctgcctccactcgaggcacgtggacanattagacatcgagngcgtcagacagaagcgagctagacttatttcgngtacagttcttacgagtacgtacgaaggttcgttaacttatacggttacttaccggtaacgtaccggg

SEQ ID NO: 324148 - DNA, 682 bp, Homo sapiens
  misc_feature: GZ8MTXP02IZFZA.51.39.D06.1.454.CMB.2.raw
  modified_base (129)..(129): a, c, t, g, unknown or other
  misc_feature (129)..(129): n is a, c, g, or t
  modified_base (181)..(181): a, c, t, g, unknown or other
  misc_feature (181)..(181): n is a, c, g, or t
  modified_base (275)..(275): a, c, t, g, unknown or other
  misc_feature (275)..(275): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtntctcaccatggcctggatccctctacttcctccccctctcactctctgcacnggctctgacgcctcctatgtgctgacacacgcccacccgtggtcgtccgtcgtccccgaggacaggacggccaggactcacctgctcgtggagntgactattcgacccaaacctattatttacttagttacggtaacccaaacgaagaacgccgacggcccacggtccccttggttcgttgtagtaataataaagtaaaagactaaggtgaagtacgtccttacggagggtaccttcccgtagaacgcgttaacttctacgtcggccctacccgacgtcgaacggtacctacggtcggtaccacgtacttacgaccctaagtacgtacggtaggtaccgtaccgaggaccgaaggaaacggtacggaaggtctaacgtaactttacgtttacgtagttacctaaactttccgttacgaaaacggttcccgtaacgttaaggttacgtttaaaccgtttagtaccggtttaccgttaaccgggtaaaccggttaacccgggg

SEQ ID NO: 324149 - DNA, 740 bp, Homo sapiens
  misc_feature: GZ8MTXP02HBE5V.51.39.D06.1.454.CMB.2.raw
  modified_base (128)..(128): a, c, t, g, unknown or other
  misc_feature (128)..(128): n is a, c, g, or t
tcagcgatcgtatacacgaccggtgctcgatttagtgacatctcgcagttctttgggcacgaccggtgctcgatttagtgacatctcgcagttctttgggggtggtccaggaggcagaactctgggtntctcaccatggcctggatccctctacttcctccccctctcactctctgcacaggctctgacggcctcctatgtgctgacacacgccctacccgtggtcgtccgtcgtccccaggacaggacgccaggactcacctgctcgtgggatatcgactacgttaccgacccctaaaccctactttactttacctttaaagtttaccggtaaacccaaacgaacggaaaccgaccccggaaacggccccgtaacgggtcccccttaggtttacggtttagtagtaaattaaccgttaaagtaaacgaacgtaggtacggaaggtacgggtccctttaggaacggggtaaccttcccgttagggacggtaccttaactttccgtcgttacggtccctacccgaaccgttacgaacgggtacctaacgttcgggtaccaactacgttacgaacctacgtacgtaacgggtcggtaaccggtaccgaacggggaacaaacgggaacgaacgggaacgtcgtaacgttactttagttccgtaagttacctaaattccgttacgacgtaacgttctaaggtttactacgtttactacggttaccgttacggaacgtaaccggg

SEQ ID NO: 324150 - DNA, 650 bp, Homo sapiens
  misc_feature: GZ8MTXP02GFSAJ.51.39.D06.1.454.CMB.2.raw
  modified_base (221)..(221): a, c, t, g, unknown or other
  misc_feature (221)..(221): n is a, c, g, or t
tcagcgatcgtatacacgaccggtgctcgatttagtgacatctcgcagttctttgggcacgaccggtgctcgatttagtgacatctcgcagttctttgggggtggtccaggaggcagaactctgggtgtctcaccatggcctggatccctctacttctccccctctcactctctgcacaggctctgaggcctcctatgtgctgacacagcccaccgtggtntccgtgtccccagggaccaggacggccaggatcacctgctctggagatgcattcgacccaaccctactatttaccttagttacggtaaccaaacagaaagcccgaaggacccacgggcccccttggttgttcgttagtataataataaaagaacagtagaagacggtccttacgaagggtactacccgtgaacgtcgtaattctcgtcggtcctcccaaccgtaccgaagggacctaccgtacgggtcaaaccgtattacgaaccataccgaggttacggtacgacccgaagcgaaaggaaaggaacgaggacttacggaacctaagttttctacgttactaaaacgttcttaccgaaagtacgttaccgtaaggttaggtttaacttaacgttcgtttaacgttaaccggtaacgtttaaacccgggg

SEQ ID NO: 324151 - DNA, 655 bp, Homo sapiens
  misc_feature: GZ8MTXP02JFL16.51.39.D06.1.454.CMB.2.raw
  modified_base (481)..(481): a, c, t, g, unknown or other
  misc_feature (481)..(481): n is a, c, g, or t
tcagcgatcgtatacacgaccggtgctcgatttagtgacatctcgcagttctttgggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccaacagaagccagccaggcccctgtgttgtgatatataaagacagtgagagccttagagggatcccgtagagcgtatttccctcgtggcctccaccctcgaacgggactacgttggtccaacctagtttacgaaccctagtaccaggttggacgtccgagggcaagaaacgacgaggctaggacttagtttctaggttacaaattccctttagaacgtaccggttanaggttagggttaacctttagttcggtttacgttacgggtaaaacgtttcggggaaacccgtaaaaggggttccctaaacccgggtttacccgtaaagggttcccgaaacggcccccgtaaaacgggtacccccaaaaccccccggtattaccggtaccctaaccggtttccccg

SEQ ID NO: 324152 - DNA, 631 bp, Homo sapiens
  misc_feature: GZ8MTXP02ING24.51.39.D06.1.454.CMB.2.raw
  modified_base (129)..(129): a, c, t, g, unknown or other
  misc_feature (129)..(129): n is a, c, g, or t
  modified_base (276)..(276): a, c, t, g, unknown or other
  misc_feature (276)..(276): n is a, c, g, or t
  modified_base (547)..(547): a, c, t, g, unknown or other
  misc_feature (547)..(547): n is a, c, g, or t
  modified_base (562)..(562): a, c, t, g, unknown or other
  misc_feature (562)..(562): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtntctcaccatggcctggatccctctacttctcccccctctcactctctgcacaggctctgacggcctcctatgtgctgacacacgcccacccgtggtcgtccgtcgtccccaggaccagacggccaggactccactgtcctgtggaanatgactattccgacccaaccctatttactttacttaagtttacggaaccaaacgtacgaacgcccgacggaccctacggtcccccgttaggtttacggtttgttagtaatttaagtaaactaaacgataggtagaggaaccgttccgttagaacgggtcctaccccgtaggacgtacgttacttctgaccggtcctcccacgtcgacggcctaacgtcgtacacgtatacgactataacgtgtacggactacggacgacgaagacgaaggngtacgtagtactttnttcgtactacttactacgtacgtacgtacgtagtaacgttactacttcgtacgttcgtaacgacgtacg

SEQ ID NO: 324153 - DNA, 595 bp, Homo sapiens
  misc_feature: GZ8MTXP02FQDQW.51.39.D06.1.454.CMB.2.raw
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagcccaccctggtgtccgtgtccccaggacagacggccaggatcacctgctctggagatgcattcgcccaacccactatttcttattcggtaccaacagaacgccaggccacggcccctgtgttgttgatatataaagacagtagagagccttgagggactcccgtgagcgtattctcgtcggcctccaccgtcgacgggactacgtggtaccactagtttacgaccctaattccgaggttcgggtaacgtaccgaggacgaaggaaacgaacggaggaccgtaggaactttaacgtttcgtagtacctaaattcctttacgacgtaccgtacgtaaggttacgttaactttagtcggtttcgttacgggtaaccgttaaccgggg

SEQ ID NO: 324154 - DNA, 674 bp, Homo sapiens
  misc_feature: GZ8MTXP02IDLB0.51.39.D06.1.454.CMB.2.raw
  modified_base (128)..(128): a, c, t, g, unknown or other
  misc_feature (128)..(128): n is a, c, g, or t
  modified_base (265)..(265): a, c, t, g, unknown or other
  misc_feature (265)..(265): n is a, c, g, or t
tcagcgatcgtatacacgaccggtgctcgatttagtgacatctcgcagttctttgggcacgaccggtgctcgatttagtgacatctcgcagttctttgggggtggtccaggaggcagaactctgggtntctcaccatggcctggatccctctacttcctcccctctcactctctgcacaggctctgacgcctctatgtgctgacacacgcccacccgtcggtcgtccgtcgcccgaggacaggaccgccaggactcactgctcgnggagatcgctactcgacccctaacctactttactttacttagtttacggaaccaacgaagaacgccgacggaccgacggtccctggttcgtttagtacgtaattaacgtaaagtaaaacgtacgtaggttacgaaggtcgtccgttacggacgtacctcccgtagcgcttactcttcgcgtccctaccgacgtcgtacggacctacggtcgacctactacgttaccgactacgtacgtagggtacggtaccgtacgaacggaacgaaacgggaacggtaacggacgttacgtacgtaaaacctttcgtttcgttacgtaaccttaaacgtttccgtaaacgacgtacgttaccgtaaggtttacgttaacgttacggtcgtttaccggtaacggtaaccgtaaccgggg

SEQ ID NO: 324155 - DNA, 625 bp, Homo sapiens
  misc_feature: GZ8MTXP02HXEY7.51.39.D06.1.454.CMB.2.raw
tcagcgatcgtatacacgaccggtgctcgatttagtgacatctcgcagttctttgggcacgaccggtgctcgatttagtgacatctcgcagttctttgggggtgggtccaggaggcagaactctgggtgtctcaccatggcctggatccctctacttctcccctctcactctctgcacaggctctgaggcctcctatgtgctgacacagccaccgtggtcgtccgtgtccccaggacaggacggccaggactcacctgctcgtggagatgctattcgcccaaccacttattctttattcgtaccaaacagaacgtccaggccacggcccctagtgttcgtgtactatataaaacgactagtgacggacggtcctttacggaaggggtctcccgttagacgcggtattctcgtcggctaccgaccctcgacggggtactacgtcggtaccactattacgaacctataccgagtaggacggtaccacgggacaagggacgaacggtagggtacgtacggaactttacgtttacctggttaacctaaactttccgttacgacggttacgtaccgtaagttccgggttaatttacgttacggtttacgttacggtaaaacgttccgggg

SEQ ID NO: 324156 - DNA, 718 bp, Homo sapiens
  misc_feature: GZ8MTXP02IGQUG.51.39.D06.1.454.CMB.2.raw
  modified_base (201)..(201): a, c, t, g, unknown or other
  misc_feature (201)..(201): n is a, c, g, or t
tcagcgatcgtatacacgaccggtgctcgatttagtgacatctcgcagttctttgggcacgaccggtgctcgatttagtgacatctcgcagttctttggggggtgggtccaggaggcagaactctgggtgtctcaccatggcctggatccctctacttcctcccctctcactctctgcacaggctctgagcctcctatgtnctgacacagccaccgtcggtcgtccgtcgccccgaggacagacggccaggactcactgctctggagatgctatcgacccaacctacttattacttagttacgtaaccaacgagaacgccgaacggccgtacggtcccttggttgtttcgttagtaattaaacttaaaagtaaaagacgtaaggtaggacggtacgtcccgttaggaacggtaccttacccgtagacgtacgttacttcccgttacgtaccggtcccttacccggtaaccgttacgggaaaccgggaaccttaccggttacggtaccctaaacggttaccgtttaacgaaccctaaacgttcggtacggttacgggtaaccggtaccggacggaaccggaaaggaaaacggacggtaacggtcgtaacgtaccgtttagtttaccgtataccgttaaactcgtttaacgaaccgttacgtacgtaacgttacggttaactttacggtacgtttaccggtaacggttaacggtaccggg

SEQ ID NO: 324157 - DNA, 671 bp, Homo sapiens
  misc_feature: GZ8MTXP02I297G.51.39.D06.1.454.CMB.2.raw
  modified_base (129)..(129): a, c, t, g, unknown or other
  misc_feature (129)..(129): n is a, c, g, or t
  modified_base (568)..(568): a, c, t, g, unknown or other
  misc_feature (568)..(568): n is a, c, g, or t
tcagcgatcgtatacacgaccggtgctcgatttagtgacatctcgcagttctttgggcacgaccggtgctcgatttagtgacatctcgcagttctttgggggtgggtccaggaggcagaactctgggtntctcaccatggcctggatccctctacttcctccccctctcactctctgcacaggctctgacggcctcctatgtgctgacacacgccaccctcggtcgtccgtcgtaccccaggacagacgcaggctcactgctcgtggagatgctattcgaccaaccctactatttactagtttacggaccaaacgagtaacgaccacggacccacggtccccttggttacgtttgttacgaattaagtaacgtaaacgtactaaggttcggaaggacggttccctttacgggaacggggtacctcccgtagacggtcgttacttcgtcgtcggtacccttacccgaaccgttacggaacggtacctaacgttcggtaacaaacttacgttaccgaaacctacgtacgtaggttaccggacgtacccgaagtacgaaggaacgaacggngtaccgtagttacttaacgttttcacgttactaaacgttcgttacgaacgttcttaggtaacgtagttaacttagtcgtttaccgtacggacgtttaaccggg

SEQ ID NO: 324158 - DNA, 682 bp, Homo sapiens
  misc_feature: GZ8MTXP02GJK5H.51.39.D06.1.454.CMB.2.raw
  modified_base (395)..(395): a, c, t, g, unknown or other
  misc_feature (395)..(395): n is a, c, g, or t
tcagcgatcgtatacacgaccggtgctcgatttagtgacatctcgcagttctttgggcacgaccggtgctcgatttagtgacatctcgcagtttctttggggggtgggtccaggaggcagaactctgggtgtctcaccatggcctggatccctctacttcctccccctcctcactctctgcacaggctctgacggccctcctagtgtgctagacacacgccctacccgtcggtcgtcccgtcgtaccccgaggacacggaccggccaaggactccaccgtgcctcgtgggacatgcagttccgacccaaccctattactttcttagttacggaaccaaacgagaacgccacggacccaccggtcccttggttgtttacgtataaagtaactaaanaaacgactaggtagaggtacgtccgttggaacggtactcccgtagacgtacgtactttccgtcgtcggccctacccgtaccgtaacgacggactcgacggtacactagttacgacctacgtacgaggtacggacgtaccgaaggacgaaggaaggaccgagtacgttagtaactttactttacgttacgtaacttaacgtttcctacgtaaacgtaccgttaacgttaaggttacggtttaactttacgttcggtttaacggtaaccgggttacggtaaacccgggg

SEQ ID NO: 324159 - DNA, 510 bp, Homo sapiens
  misc_feature: GZ8MTXP01EUB6Y.21.38.D05.1.454.CMB.2.raw
  modified_base (202)..(202): a, c, t, g, unknown or other
  misc_feature (202)..(202): n is a, c, g, or t
  modified_base (388)..(388): a, c, t, g, unknown or other
  misc_feature (388)..(388): n is a, c, g, or t
  modified_base (440)..(440): a, c, t, g, unknown or other
  misc_feature (440)..(440): n is a, c, g, or t
  modified_base (465)..(465): a, c, t, g, unknown or other
  misc_feature (465)..(465): n is a, c, g, or t
tcagtcgtcgctcgcacgaccggtgctcgatttagtatctgatagttgggtttggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaaacctggccaggctcccagtctcctcatctatggggcatcctacaggatgaccggcatccccagacaggttcagtgccagtgggtctgggacagaacttcaactctcaccatcaacacactggcncctgaagtattttgcagtgtattactgtcagatggtatggtagtcacgtacncctttggccaggggccaaggtgganaatcagacgaatgtggcttgcaacatctgtcttcaattcttcccg

SEQ ID NO: 324160 - DNA, 505 bp, Homo sapiens
  misc_feature: GZ8MTXP01DS9NK.21.38.D05.1.454.CMB.2.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (364)..(364): a, c, t, g, unknown or other
  misc_feature (364)..(364): n is a, c, g, or t
  modified_base (387)..(387): a, c, t, g, unknown or other
  misc_feature (387)..(387): n is a, c, g, or t
  modified_base (414)..(414): a, c, t, g, unknown or other
  misc_feature (414)..(414): n is a, c, g, or t
  modified_base (440)..(440): a, c, t, g, unknown or other
  misc_feature (440)..(440): n is a, c, g, or t
  modified_base (463)..(463): a, c, t, g, unknown or other
  misc_feature (463)..(463): n is a, c, g, or t
  modified_base (486)..(486): a, c, t, g, unknown or other
  misc_feature (486)..(486): n is a, c, g, or t
  modified_base (495)..(495): a, c, t, g, unknown or other
  misc_feature (495)..(495): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttncctggtaccaacaaaacctggccaggctcccagtctcctcatctatggggcatcctacaggatgaccggcatccccaagacaggttcagtgccagtgggctggggacagaaccttcnctctcaccatcaacacactggcncctgaatattttgactagtgtattacngtcagatggtatggtagtcacgtacnccgttggccagggacaggtgagntcagacaagtgtgcttgctaacntctgtcttnaattctcccg

SEQ ID NO: 324161 - DNA, 569 bp, Homo sapiens
  misc_feature: GZ8MTXP01EM9YH.21.38.D05.1.454.CMB.2.raw
  modified_base (207)..(207): a, c, t, g, unknown or other
  misc_feature (207)..(207): n is a, c, g, or t
  modified_base (395)..(395): a, c, t, g, unknown or other
  misc_feature (395)..(395): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctaggtaccaacaaaacctggccaggctcccagtctcctcatctatggggcatcctacaggatgaccggcatcccagacaggttcagtcgccccaggtgggtctggggacaagacttcactctcacatcaacacactggcnctgaagtattttgctagtgtattactgtacagagttgtagttgggtagtctaccgtactaccgtttggccgtagggggaccaaagggtgggaagtacgttcgaagacgtaaacgtggttacgggcttacggcctaaccctaattcgtggttcctttccgttaacgtttcccccg

SEQ ID NO: 324162 - DNA, 518 bp, Homo sapiens
  misc_feature: GZ8MTXP01DU4X1.21.38.D05.1.454.CMB.2.raw
  modified_base (201)..(201): a, c, t, g, unknown or other
  misc_feature (201)..(201): n is a, c, g, or t
  modified_base (362)..(362): a, c, t, g, unknown or other
  misc_feature (362)..(362): n is a, c, g, or t
  modified_base (385)..(385): a, c, t, g, unknown or other
  misc_feature (385)..(385): n is a, c, g, or t
tcagtcgtcgctcgcacgaccggtgctcgatttagtatctgatagttgggtttggggaagagctgctcagttaggacccagagggaaccatggaaaccccagcgcagcttctcttcctcctgctactctggctccaggtgtcaccggagaagttgtcttgacgcagtctccaggcaccctgtctctgtctccaggggaaangttactctctcctgcaaggccagtcagagtgttggcatcgacgttgcctggtaaccaacaaaacctggccaggctcccagtctcctcatctatggggcatcctacaggatgaccggcatcccagacaggttcagtgccagtgggtctgggacagaacttcnctctcaccatcaacacactggcncctgaacgattttgactagtgtattactgtcagtatggtatgggtagtcaccgtacactttggaccgtagggaccaaggtggagaatcagacgaacgtgtgcttgcaaccatctgtcttctaacttcttcccg

SEQ ID NO: 324163 - DNA, 503 bp, Homo sapiens
  misc_feature: GZ8MTXP01BGWVL.21.38.D05.1.454.CMB.2.raw
  modified_base (203)..(203): a, c, t, g, unknown or other
  misc_feature (203)..(203): n is a, c, g, or t
  modified_base (274)..(274): a, c, t, g, unknown or other
  misc_feature (274)..(274): n is a, c, g, or t
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccacaaaacctgcaggcnccagtctctcatctatgggcatcctacaggatgaccggcatcccagacaggttcagtgccagtgggtctgggacagaacttcaactctcacatcaacacactgcncctgaagtattttgctagtgtattacngtcagatggtatggtagtcaccgtacactttggcctagggaccaaggtggagaatcagacgagtgtggcttgcaaccatctgtcttcaattctcccg

SEQ ID NO: 324164 - DNA, 569 bp, Homo sapiens
  misc_feature: GZ8MTXP01AOCKO.21.38.D05.1.454.CMB.2.raw
  modified_base (206)..(206): a, c, t, g, unknown or other
  misc_feature (206)..(206): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctaggtacaacaaaacctggccaggctcccagtctcctcatctatggggcatcctacaggatgaccggcactcccagacaggttcagtgccccaggtgggtctggggacaagtcttcactctccacctatacaaacacacctgggcctccgtgaaacgtattttcgactagttgttaattacgtgttacaggtattggttatgggtaggtcctaccgtactaccgtttgggccgtaggggtaacccaagggtgggaagtagttacgaggaccgtaagtggttgcttggccactaatctgttcttcgaactttcccg

SEQ ID NO: 324165 - DNA, 531 bp, Homo sapiens
  misc_feature: GZ8MTXP01D42LJ.21.38.D05.1.454.CMB.2.raw
  modified_base (205)..(205): a, c, t, g, unknown or other
  misc_feature (205)..(205): n is a, c, g, or t
  modified_base (367)..(367): a, c, t, g, unknown or other
  misc_feature (367)..(367): n is a, c, g, or t
  modified_base (419)..(419): a, c, t, g, unknown or other
  misc_feature (419)..(419): n is a, c, g, or t
  modified_base (484)..(484): a, c, t, g, unknown or other
  misc_feature (484)..(484): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgccctggtaccaacaaaacctggccaggctcccagtctcctcatctatggggcatcctacaggatgaccggcatcccagacaggttcagtgccccaggtggtctgggacaagacttnactctcaccatcaaacacactgcgcctgaagtattttgctaagtgtattacngtacagtatgttatggtaggttcaccgttacaccgtttggccctaggggaccaaagggtggaagnttcgagttacgaactgttggcttgcacaatctgttcttcaatttccg

SEQ ID NO: 324166 - DNA, 543 bp, Homo sapiens
  misc_feature: GZ8MTXP01BYX11.21.38.D05.1.454.CMB.2.raw
  modified_base (208)..(208): a, c, t, g, unknown or other
  misc_feature (208)..(208): n is a, c, g, or t
  modified_base (489)..(489): a, c, t, g, unknown or other
  misc_feature (489)..(489): n is a, c, g, or t
  modified_base (521)..(521): a, c, t, g, unknown or other
  misc_feature (521)..(521): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggccaccctgtctctgtctccgaggggaaangttactctctcctgcaaggccagtcagagtgttggcatcgacgttgccctaggtaccaaacaaaacctggccaggctcccagtctcctcatctatggggcatcctacaggatcgaccggcactcccagacaggttcagtgcccgaggtgggtctgggacagacttcactctcaccatacaacacactggccgcctgaagtattttgctagtgttattactgtacagtagtgtagtggtagtcaccgtctacgtttgggccgtaggggaccagggtggaagnttcgagacgaacgttggcggcttcggctaccngttctgttccttcgctttcccg

SEQ ID NO: 324167 - DNA, 514 bp, Homo sapiens
  misc_feature: GZ8MTXP01DG9JI.21.38.D05.1.454.CMB.2.raw
  modified_base (204)..(204): a, c, t, g, unknown or other
  misc_feature (204)..(204): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
  modified_base (486)..(487): a, c, t, g, unknown or other
  misc_feature (486)..(487): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
tcagtcgtcgctcgcacgaccggtgctcgatttagtatctgatagttgggtttgggggaagagctgctcagttaggacccagagggaaccatggaaaccccagcgcagctttttcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaaacaaaaacctggccaggctcccagtctcctcaatctatggggcatcctacaggatgaccggcatcccagacaggttcagtgccagtgggtctggggacagacttcactctcaccaatcaaacacacngcncnatattntnagtgtatatgtnagatgtagtaggtaggtacgtaccgtactacgttcgtacgacgggacgaaggtagaganaanagagacngtgnngcacaatntntctcttactcttccgtc

SEQ ID NO: 324168 - DNA, 554 bp, Homo sapiens
  misc_feature: GZ8MTXP01CGIYP.21.38.D05.1.454.CMB.2.raw
  modified_base (207)..(207): a, c, t, g, unknown or other
  misc_feature (207)..(207): n is a, c, g, or t
  modified_base (306)..(306): a, c, t, g, unknown or other
  misc_feature (306)..(306): n is a, c, g, or t
  modified_base (388)..(388): a, c, t, g, unknown or other
  misc_feature (388)..(388): n is a, c, g, or t
tcagtcgtcgctcgcacgaccggtgctcgatttagtatctgatagttgggtttggggggagaagagctgctcaattaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttgcatcgagttgcctagtaccaacaaaactggccaggctccagtctcctcatctatgggcatcctanaggatgaccggcatcccagacagttcagtcgccccgaggtggtcgtggacaagtactcactctcacatacaacacactggcncctagaatattttgactagttgtattactgtacagtatgttatggtaacggtctaaccgtacaccgttttacgggaccgaagggggtacaaacgggtggaacgtagttccgaaggacgtaaacgtgttgggcttacggcacctaattctagttcttcgctttcccg

SEQ ID NO: 324169 - DNA, 556 bp, Homo sapiens
  misc_feature: GZ8MTXP01DTDUG.21.38.D05.1.454.CMB.2.raw
  modified_base (206)..(206): a, c, t, g, unknown or other
  misc_feature (206)..(206): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgccctaggtaccaacaaaacctggccaggctcccagtctcctcatctatggggcatcctacaggatgaccggcactcccagacaggttcagtcgccccaggtgggtctgggacaagacttcactctcacatacaacacactggccgactgaacgtattttggactagttgtattactgtacagtagtgtagtggtacggtcaccggttactaccgtttggccgtaaggggaccaagggtggaagtattacgaggacgtaaacgtggttacggcttaggcactaatctgttctttcgaatttcccc

SEQ ID NO: 324170 - DNA, 545 bp, Homo sapiens
  misc_feature: GZ8MTXP01CQE2K.21.38.D05.1.454.CMB.2.raw
  modified_base (203)..(203): a, c, t, g, unknown or other
  misc_feature (203)..(203): n is a, c, g, or t
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctaggtaccaaacaaaacctggccaggctcccagtctcctcatctatggggcatcctacaggatgaccggcatcccagacaggttcagtgccagtgggtctgggacagacttcnctctcaccatcaacacactgcncctgaagtatttggactagttgtattactgtacagtatggtatgggttagtccaccgtactacctttagggcccgaagggggtaccaagggtcggaagtaagtacaggacgttaaacgtggtgacgttgacaaccatctgtcttctaattccttcccg

SEQ ID NO: 324171 - DNA, 566 bp, Homo sapiens
  misc_feature: GZ8MTXP01CTFI9.21.38.D05.1.454.CMB.2.raw
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
  modified_base (524)..(524): a, c, t, g, unknown or other
  misc_feature (524)..(524): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctccaggtgtcaccggagaagttgtcttgacgcagtctccaggcaccctgtctctgtctccaggggaaangttactctctcctgcaaggccagtcagagtgtgcatcgagttgcctagtaccaacaaaacctggccaggctccagtctcctcatctatgggcatcctanagatcgaccgcatcccagacaggttcagtcgcccgtaggtgggtcgtgggacaacgtacttcactctacaccatacaacacactgcgcctagaagtatttgctagtcgtattactgtactagtagtagtagtggtagtacaccgtactacgtttcggaccgtaggggaccgtaagggtaggaagtaacgttcgaaggaacgtaaacgtggttacggttcncggtaaccacgtaacttcgtcgtttacttcgttaacttcccg

SEQ ID NO: 324172 - DNA, 508 bp, Homo sapiens
  misc_feature: GZ8MTXP01APIBD.21.38.D05.1.454.CMB.2.raw
  modified_base (202)..(202): a, c, t, g, unknown or other
  misc_feature (202)..(202): n is a, c, g, or t
  modified_base (386)..(386): a, c, t, g, unknown or other
  misc_feature (386)..(386): n is a, c, g, or t
  modified_base (410)..(410): a, c, t, g, unknown or other
  misc_feature (410)..(410): n is a, c, g, or t
  modified_base (434)..(434): a, c, t, g, unknown or other
  misc_feature (434)..(434): n is a, c, g, or t
  modified_base (487)..(487): a, c, t, g, unknown or other
  misc_feature (487)..(487): n is a, c, g, or t
tcagtcgtcgctcgcacgaccggtgctcgatttagtatctgatagttgggtttggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatgggcatcctacaggatgaccggcatcccagacaggttcagtgccagtgggtctggggacagaacttcaactctcaccatcaacacactggcncctgaagatttgcagtgtattacngtcagatggtatggtagtcacgtnactttggccaggggccaaggtgagaatcgagacgaacgtgtggcttgcaaccntctgtcttcaattcgttcccg

SEQ ID NO: 324173 - DNA, 553 bp, Homo sapiens
  misc_feature: GZ8MTXP01EK0FO.21.38.D05.1.454.CMB.2.raw
  modified_base (201)..(201): a, c, t, g, unknown or other
  misc_feature (201)..(201): n is a, c, g, or t
  modified_base (276)..(276): a, c, t, g, unknown or other
  misc_feature (276)..(276): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaacctggccaggcncccagtctctcatctatgggcatcctacaggatgaccggcactcccagacaggttcagtgccagtgggtctggggacagaacttcaactctacaccatacaaacacactggcgcctagaagtntttgactagttgtattacngtcagtatgggttatgggtagtcaaccgtactaccgtttggccgaggggtacctaagggtggaagaacttcgaaggtaccgaaagtggtcggacttcgacaaccattctggtccttctaacgttccttaaccccg

SEQ ID NO: 324174 - DNA, 541 bp, Homo sapiens
  misc_feature: GZ8MTXP01EEM53.21.38.D05.1.454.CMB.2.raw
  modified_base (202)..(202): a, c, t, g, unknown or other
  misc_feature (202)..(202): n is a, c, g, or t
  modified_base (276)..(276): a, c, t, g, unknown or other
  misc_feature (276)..(276): n is a, c, g, or t
  modified_base (503)..(503): a, c, t, g, unknown or other
  misc_feature (503)..(503): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggcctcccaggtgtcaccggagaagttgtcttgacgcagtctccaggcaccctgtctctgtctccaggggaaangttactctctcctgcaaggccagtcagagtgtggcatcgacgttgcctggtaaccaacaaaacctggccaggcncccagtctcctcatctatggggcatcctacaggatgaccggcatccccagacaggttcagtgccaggtgggtctggggacagaacttcaacttctcaccatacaacacactgcgtcctagaacgtattttgactagttgtattactgttcagtatgggttatgggttacgtcaccgtactacgtttggaccgtaggggaccaagggtggagaatcgagacgttaagngtagcttgctaaccatctgtcttctaacttctaacccg

SEQ ID NO: 324175 - DNA, 647 bp, Homo sapiens
  misc_feature: GZ8MTXP01B6P6T.21.38.D05.1.454.CMB.2.raw
  modified_base (206)..(206): a, c, t, g, unknown or other
  misc_feature (206)..(206): n is a, c, g, or t
  modified_base (434)..(434): a, c, t, g, unknown or other
  misc_feature (434)..(434): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaaacaaaaccgtggaccaggcctccagtcctcctcatctagtgggcatcctacgaggatcgaccggcactcccagactaggttcagtcgcccgagggtgggtcgtaggggacaacgtacttcgacctcctaccaaccactacaaacactacgtggaccgcgtaggaaagttnttttacgactagttacgttaacttacgttgtacgtaagtagttggttaaggttcgggttaacggtacccttaacccggttaccttacccggtttagggacccggtaaacggggggacctaaagggggtggaagtaacgttacgaagggaccgtaaacgtggttacgggcttacggctaaccgtaattctacgtttcctccttaacgtttcccc

SEQ ID NO: 324176 - DNA, 515 bp, Homo sapiens
  misc_feature: GZ8MTXP01B84PZ.21.38.D05.1.454.CMB.2.raw
  modified_base (204)..(204): a, c, t, g, unknown or other
  misc_feature (204)..(204): n is a, c, g, or t
  modified_base (485)..(485): a, c, t, g, unknown or other
  misc_feature (485)..(485): n is a, c, g, or t
  modified_base (509)..(509): a, c, t, g, unknown or other
  misc_feature (509)..(509): n is a, c, g, or t
tcagtcgtcgctcgcacgaccggtgctcgatttagtatctgatagttgggtttggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaactggccaggctcccagtctcctcatctatggggcatcctacaggatgaccggcatcccagacaggttcagtgccccaggtgggtctgggacaagacttcactctcaccatcaacacactgcgcctgaagtatttgctagtgtattactgtcagatgtatggtagtcaccgtcacgtttggccgtaggggaccagggtggaagattcgagacgaacgtgnggcttggcacgaatctgttcttcnttcccg

SEQ ID NO: 324177 - DNA, 595 bp, Homo sapiens
  misc_feature: GZ8MTXP01D7L25.21.38.D05.1.454.CMB.2.raw
  modified_base (204)..(204): a, c, t, g, unknown or other
  misc_feature (204)..(204): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
tcagtcgtcgctcgcacgaccggtgctcgatttagtatctgatagttgggtttgggggaagagcttctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctaggtaacccaaacaaaacctggccaggctcccagtctcctcatctagtggggcatcctacgaggatcggaccggcactcccgagacgtaggttacagtcgccgtaggtcggggtcgtaggggacagtaccttacacttctacaaccactacaacacacgtggccnctagaagtntttgctagttgttattactgtacagtatgtaggtaggtagtactacgtactaccgttggacgaaggggaccgtaagggtcggaagagtaacgtaaggacgtaaacgttggtacggtcttacggccaaccgtaattcgtcgttcttacttcttcccgtttccccgaacc

SEQ ID NO: 324178 - DNA, 528 bp, Homo sapiens
  misc_feature: GZ8MTXP01EOR4U.21.38.D05.1.454.CMB.2.raw
  modified_base (202)..(202): a, c, t, g, unknown or other
  misc_feature (202)..(202): n is a, c, g, or t
  modified_base (364)..(364): a, c, t, g, unknown or other
  misc_feature (364)..(364): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaaggggaaangttactctctcctgcaaggccagtcagagtgttggcatcgacgttgcctggtaaccaacaaaaacctggccaggctcccagtctcctcatctagtgggcatcctacaggatgaccggcatcccagacaggttcagtgccagtgggtctgggacagaacttcnctctacaccatacaacacactggcncctagaagtntttgactagtgtattactgtcagattggtaagtggtaggtcaccgtactccgtttggaccgaggggtaccaagggtgagaatcgagacgaagtggtggcttgacaacatctgtcttcaacttcctcccg

SEQ ID NO: 324179 - DNA, 558 bp, Homo sapiens
  misc_feature: GZ8MTXP01CDH2A.21.38.D05.1.454.CMB.2.raw
  modified_base (201)..(201): a, c, t, g, unknown or other
  misc_feature (201)..(201): n is a, c, g, or t
  modified_base (276)..(276): a, c, t, g, unknown or other
  misc_feature (276)..(276): n is a, c, g, or t
  modified_base (388)..(388): a, c, t, g, unknown or other
  misc_feature (388)..(388): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaacctggccaggcncccagtctcctcatctagtgggcatcctacaggatcgaccggcactcccagacaggttcagtgccaggtgggtctgggacagacttcaactctcaccatcaacacactggcnccgtagaagtatttgactagttagtattactgtacagtattgggtagttgggtacgtctaccgttactaccgtttggaccgagggggtaaccaagggtcggagaatcgaaggacgaacgtggtaggcgttgcaaccgtatccgtgtccttctaacgttccgttaaccccg

SEQ ID NO: 324180 - DNA, 535 bp, Homo sapiens
  misc_feature: GZ8MTXP01CE8VF.21.38.D05.1.454.CMB.2.raw
  modified_base (205)..(205): a, c, t, g, unknown or other
  misc_feature (205)..(205): n is a, c, g, or t
  modified_base (393)..(393): a, c, t, g, unknown or other
  misc_feature (393)..(393): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgagttgcctggtaccaacaaaactgcaggctccagtctctcatctatggggcatcctacaggatgaccggcactcccagacagttcagtgcccaggtgggtctgggacaagacttcactctcacatcaaacacactgcgcctagaagtnttttgctagtgtattactgtcagtatgttatgggtacgtctaccgtactaccgtttggccgtaagggggacctaagggtggaagagttcgaggacgtaacgtggagggcttggcacctaagtctgttacttcaactttcccg

SEQ ID NO: 324181 - DNA, 563 bp, Homo sapiens
  misc_feature: GZ8MTXP01D3NTL.21.38.D05.1.454.CMB.2.raw
  modified_base (208)..(208): a, c, t, g, unknown or other
  misc_feature (208)..(208): n is a, c, g, or t
  modified_base (402)..(402): a, c, t, g, unknown or other
  misc_feature (402)..(402): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgagggggaaangttactctctcctgcaaggccagtcagagtgttggcatcgagttgccctaggtaaccaacaaaacctggaccaggctcccagtctcctcatctatggggcatcctacaggatgaccggcactcccagacaggttcagtcgcccaggtgggtctggggacaagacttcactctacaccatacaaacacactggcncctgaatattttgctagttgtattactgtacagtagttgtagttgggtacgtcaccgtactaccgtttacgggccgtaagggggaaccgaagggtggaagtacttcgaagacgaaacgttggttggcttgaactactaatctgttccttcaacgtttcccg

SEQ ID NO: 324182 - DNA, 562 bp, Homo sapiens
  misc_feature: GZ8MTXP01DUPE9.21.38.D05.1.454.CMB.2.raw
  modified_base (203)..(203): a, c, t, g, unknown or other
  misc_feature (203)..(203): n is a, c, g, or t
  modified_base (278)..(278): a, c, t, g, unknown or other
  misc_feature (278)..(278): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaacctggccaggcncccagtctcctcatctatggggcatcctacaggatgacgcatcccagacaggttcagtgcctaggtgggtctgggacagtaaccttcnctctcaccatcaacacactggcncctagaagtattttgactagttgttattacgtgtacaagtattgggttagtggggttaacggtaccgtaaccgttaccgtaccgtttcggaccgagggggtaccaagggtcggagaatcgagtacgaacgtggtcggacttgacaacatcgtgtcttcaacttccgttccccg

SEQ ID NO: 324183 - DNA, 603 bp, Homo sapiens
  misc_feature: GZ8MTXP01C02ON.21.38.D05.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (305)..(305): a, c, t, g, unknown or other
  misc_feature (305)..(305): n is a, c, g, or t
  modified_base (438)..(438): a, c, t, g, unknown or other
  misc_feature (438)..(438): n is a, c, g, or t
tcagtcgtcgctcgcacgaccggtgctcgatttagtatctgatagttggggtttgggggggagaagagctgctcagttaggacccagagggaaccatggaaaccccagcgcagcttctcttcctcctgctactctggctccaggtgtcaccggagaagttgtcttgacgcagtctccaggcacctgtctctgtctccgaggggaaangttacnctctctgcaaggccagtcagagtgtgcatcgagttgcctagtaccaaacaaaactggccaggctccagtctctcatctagtgggcatcctanaggatcgaccggcactccccgagacaggttcagttcgaccccgtaggtcgggtcgtacggggactaaacggtacttcgtactccttaccaacccattaccaaacacctacgttcggccgtaccgtgaaagttnttttacgacgttagttagttattactgtacgagtagttgtaagttgggtacgtacgtaaccgttacaccgtttaggaccgaaggggtaacccaagggtgggtaacgagttcgaaggaccgtaagtggttacgcttggccacgtaatcttgttcttcaacttcccg

SEQ ID NO: 324184 - DNA, 627 bp, Homo sapiens
  misc_feature: GZ8MTXP01B27N8.21.38.D05.1.454.CMB.2.raw
  modified_base (206)..(206): a, c, t, g, unknown or other
  misc_feature (206)..(206): n is a, c, g, or t
  modified_base (312)..(312): a, c, t, g, unknown or other
  misc_feature (312)..(312): n is a, c, g, or t
  modified_base (399)..(399): a, c, t, g, unknown or other
  misc_feature (399)..(399): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangtttactctctcctgcaaggccagtcagagtgttggcatcgacgttgcctaggtaccaacaaaacctggccaggctcccagtctcctcatctatggggcatcctanaggatcgaccggcatcccagacaggttcagtcgccccaggtggtctggggacaagtacttcactctcacctatcaacacactggccncctgaagtattttcgctagttgtaattactgttcagtagttaggttagttagggtacgggttcctaaccggttacctaccgtttttcggggacccgtaaggggggtaaccctaagggggttgggaacgtacgttacgaacgggaaccgtaaacggtgggttcggggcttcgggaacctaaccccgtaattcccgttaggttccctttaaccgttaacgttttcccccg

SEQ ID NO: 324185 - DNA, 671 bp, Homo sapiens
  misc_feature: GZ8MTXP01CMN54.21.38.D05.1.454.CMB.2.raw
  modified_base (208)..(208): a, c, t, g, unknown or other
  misc_feature (208)..(208): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaagggggaaangttactctctcctgcaaggccagtcagagtgttgcagtcgacgttgcctaggtaaccaaacaaaacctggaccaggctccagtctcctcatctagtgggcatcctaagagatgaccggcacgtcccagacaggttcagtcgaccccaggtggtctgggacaagtacttcactctacaccatacaacacactggccactagtaacgtatttgacgtagttgtaattacgtagtacaagtagttcggtaagttgggttaacggtacctaacccggttaaccgtccggttttaacgggaccggtaaacgggggtaaacccgtaaagggggtcgggtaaacggtaacgttaaccgggaaacgggaaaccggttaaaccggttgggttaacggggttccttacggggaaccctaacccggttaatttccggtctttacccggtttaaccttaaccggtttttcccccg

SEQ ID NO: 324186 - DNA, 531 bp, Homo sapiens
  misc_feature: GZ8MTXP01ENUYT.21.38.D05.1.454.CMB.2.raw
  modified_base (203)..(203): a, c, t, g, unknown or other
  misc_feature (203)..(203): n is a, c, g, or t
  modified_base (280)..(280): a, c, t, g, unknown or other
  misc_feature (280)..(280): n is a, c, g, or t
  modified_base (370)..(370): a, c, t, g, unknown or other
  misc_feature (370)..(370): n is a, c, g, or t
  modified_base (514)..(514): a, c, t, g, unknown or other
  misc_feature (514)..(514): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaaccaacaaaaacctggccaggcncccagtctcctcatctatggggcatcctacaggatgaccggcatccccagacaggttcagtgccagtggggtctggggacaggaacttcnctctcaccatcaacacactcggcgtcctgaacgtattttgactagttgtattactgtcagtatggtatgggtagtcacgtccacgtttggaccgtaggggaccaagggtggagaatcgagacgacgtgtaggcttgcaacatcngttcttctcttctcccg

SEQ ID NO: 324187 - DNA, 567 bp, Homo sapiens
  misc_feature: GZ8MTXP01BNT2P.21.38.D05.1.454.CMB.2.raw
  modified_base (207)..(207): a, c, t, g, unknown or other
  misc_feature (207)..(207): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgccctaggtaccaacaaaactggccaggctccagtctcctcatctatggggcatcctacaggatgaccggcactcccagacagttcagtcgcccaggtgggtctgggacaagacttcactctcaccatcaacacactgcnctagaagtntttgctagtgtattactgtacagagttgtagtgggtaacggtcaaccgtactaccgtttcggaccgtaagggggtacctaaaggggtggaaagtacttacgaagaacgtaaacgtgggttaggcttggaaccacctaattccgtgttcttcgttaacgtttccccg

SEQ ID NO: 324188 - DNA, 548 bp, Homo sapiens
  misc_feature: GZ8MTXP01CB61S.21.38.D05.1.454.CMB.2.raw
  modified_base (206)..(206): a, c, t, g, unknown or other
  misc_feature (206)..(206): n is a, c, g, or t
  modified_base (372)..(372): a, c, t, g, unknown or other
  misc_feature (372)..(372): n is a, c, g, or t
  modified_base (503)..(503): a, c, t, g, unknown or other
  misc_feature (503)..(503): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggccaccctgtctctgtctccgaaggggaaangttactctctcctgcaaggccagtcagagtgttggcatcgacgttgcctaggtaaccaacaaaacctggccaggctcccagtctcctcatctatggggcatcctacaggatgaccggcactcccagacaggttcagtgccaggtgggtctggggacagtaacttcnctctcaccatacaacacactcggcgcctgaagtatttgactagtgtatactgtcagattgggtattggtacgtctaccgtactacgtttggccgaggggtaccaaggtggaagaatcgagacgacgttggngcgttgaccaacgatcgtgtccttacgtaacttccgttaaccccg

SEQ ID NO: 324189 - DNA, 541 bp, Homo sapiens
  misc_feature: GZ8MTXP01EAZMI.21.38.D05.1.454.CMB.2.raw
  modified_base (208)..(208): a, c, t, g, unknown or other
  misc_feature (208)..(208): n is a, c, g, or t
  modified_base (396)..(396): a, c, t, g, unknown or other
  misc_feature (396)..(396): n is a, c, g, or t
  modified_base (429)..(429): a, c, t, g, unknown or other
  misc_feature (429)..(429): n is a, c, g, or t
  modified_base (482)..(482): a, c, t, g, unknown or other
  misc_feature (482)..(482): n is a, c, g, or t
  modified_base (518)..(518): a, c, t, g, unknown or other
  misc_feature (518)..(518): n is a, c, g, or t
tcagtcgtcgctcgcacgaccggtgctcgatttagtatctgatagttggggtttgggggggagaagagctgctcagttaggacccagagggaaccatggaaaccccagcgcagcttctcttcctcctgctactctggctccaggtgtcaccggagaagttgtcttgacgcagtctccaggcaccctgtctctgtctccgaggggaaangttactctctcctgcaaggccagtcagtagtgtggcatcgacgttgcctagtaccaacaaaactggcaggctccagtctcctcatctagtggggcatcctacaggactgaccggcactcccagactagttcagtcgcccaggtgggtctggggacaagtactcgactctacaccatacacacactgcnctagagtatttgctagtgttattactgtacagngttgtacgtgtacggcacgtctacgttcggacgtaggggacctaagggtgaangttcgaagacgaaacgtggttaggccttgccacgtntccgtgttcttaaccgcttcccg

SEQ ID NO: 324190 - DNA, 529 bp, Homo sapiens
  misc_feature: GZ8MTXP01A4KHC.21.38.D05.1.454.CMB.2.raw
  modified_base (203)..(203): a, c, t, g, unknown or other
  misc_feature (203)..(203): n is a, c, g, or t
  modified_base (389)..(389): a, c, t, g, unknown or other
  misc_feature (389)..(389): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgtttgcctggtaccaacaaaacctggccaggctcccagtctcctcatctatggggcatcctacaggatgaccggcatcccagacaggttcagtgccagtgggtctggggacagaacttcaactctcaccatcaacacactggcncctgaacgtattttgcagtgtattactgtacagtatggtatggtaggtcaaccggttcaccgtttggcccgtaggggtaccaagggtgagaatcgagacgagtgtggcttgcctaacatcctgtcttcaacttcgtcccg

SEQ ID NO: 324191 - DNA, 534 bp, Homo sapiens
  misc_feature: GZ8MTXP01AHGDO.21.38.D05.1.454.CMB.2.raw
  modified_base (203)..(203): a, c, t, g, unknown or other
  misc_feature (203)..(203): n is a, c, g, or t
  modified_base (279)..(279): a, c, t, g, unknown or other
  misc_feature (279)..(279): n is a, c, g, or t
  modified_base (310)..(310): a, c, t, g, unknown or other
  misc_feature (310)..(310): n is a, c, g, or t
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
  modified_base (420)..(420): a, c, t, g, unknown or other
  misc_feature (420)..(420): n is a, c, g, or t
  modified_base (501)..(501): a, c, t, g, unknown or other
  misc_feature (501)..(501): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctaggtaccaacaaaacctggccaggcncccagtcctcctcatctagtgggcatcctanaggatgaccggcatcccagacaggttcagtcgccagtgggtctggggacagaacttcaactctcaccatcaacacactgcncctagaacgtntttgctagtgtaattacngtcagtatgggtatggtaggtacaccgtactccgttggaccgtaggggaccaagggtggaagaagtcgagacgaacgtggnggcttgacaacatctgtcttcaagttcctcccg

SEQ ID NO: 324192 - DNA, 543 bp, Homo sapiens
  misc_feature: GZ8MTXP01DAM5H.21.38.D05.1.454.CMB.2.raw
  modified_base (202)..(202): a, c, t, g, unknown or other
  misc_feature (202)..(202): n is a, c, g, or t
  modified_base (277)..(277): a, c, t, g, unknown or other
  misc_feature (277)..(277): n is a, c, g, or t
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaaggggaaangttactctctcctgcaaggccagtcagagtgttggcatcgacgttgcctggtaaccaacaaaactggaccaggcnccagtctcctcatctagtgggcatcctacaggatcgacggcatcccagacagttcagtcgccgtaggtgggtctgggacagaacttcnctctcacatacaacacactgcnctagaatntttgctaagttgtattacngtacagtatgggtattggtagtctaccgtactccgtttggaccgtagggtaccgtaagggtcgaagtaatcgaaggaccgaagtggtggcgttgcctaacctatcgtatcttactaacgttcctccccg

SEQ ID NO: 324193 - DNA, 575 bp, Homo sapiens
  misc_feature: GZ8MTXP01BMEX4.21.38.D05.1.454.CMB.2.raw
  modified_base (207)..(207): a, c, t, g, unknown or other
  misc_feature (207)..(207): n is a, c, g, or t
  modified_base (318)..(318): a, c, t, g, unknown or other
  misc_feature (318)..(318): n is a, c, g, or t
  modified_base (420)..(420): a, c, t, g, unknown or other
  misc_feature (420)..(420): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctctgcaaggccagtcagagtgttggcatcgacgttgccctaggtaaccaaacaaaacctggaccaggcctcccagtcctcctcatctagtggggcatcctanaggatcgaccggcactcccagacaggttcagtcgccccgaggtgggtcgtgggacaagtacctcgactctcaccatacaacacactcggctccgtagaagtntttagctagtgtattactgtacagagttgttagtggtacgtcctaccgtactaccgtttagggccgtaagggggtaccaagggtggaagtacgttcgaagacgtaagtgttacggcttggaacctacgtaagttctcgttacttcaacgtttccg

SEQ ID NO: 324194 - DNA, 551 bp, Homo sapiens
  misc_feature: GZ8MTXP01BZRM4.21.38.D05.1.454.CMB.2.raw
  modified_base (204)..(204): a, c, t, g, unknown or other
  misc_feature (204)..(204): n is a, c, g, or t
  modified_base (280)..(280): a, c, t, g, unknown or other
  misc_feature (280)..(280): n is a, c, g, or t
  modified_base (415)..(415): a, c, t, g, unknown or other
  misc_feature (415)..(415): n is a, c, g, or t
  modified_base (529)..(529): a, c, t, g, unknown or other
  misc_feature (529)..(529): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaaggggaaanagttactctctcctgcaaggccagtcagagtgttggcatcgacgttgcctggtaaccaacaaaacctggacaggcncccagtctcctcatctagtgggcatcctacaggatcgaccggcactcccgagacgaggttcagtcgaccgaggtgggtcgtaggggacacgtacttcaactctcaccatacaaccacactggcgtcctagaagtntttgctagttagttattactgtacagtatagggtagttagggtagtacctaccgtctaccgtttggaccgaggggtaccagggtgagaatcagacgagtggtgcgttgcaactntcttgtcttactcttccgtccc

SEQ ID NO: 324195 - DNA, 648 bp, Homo sapiens
  misc_feature: GZ8MTXP01A8M16.21.38.D05.1.454.CMB.2.raw
  modified_base (200)..(200): a, c, t, g, unknown or other
  misc_feature (200)..(200): n is a, c, g, or t
  modified_base (276)..(276): a, c, t, g, unknown or other
  misc_feature (276)..(276): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcacctgtctctgtctccaggggaaangttactctctcctgcaaggccagtcagagtgttggcatcgacgttgcctaggtaaccaacaaaacctggccaggcncccagtctcctcatctatgggcatcctacaggatgaccggcactcccagacgtaggttacaggtcgccgtaggtgggtcgtggggactagtaacttcgctcctacaccatacaacacacgtggcgcctagaacgtatttgactagttgtacttacgtgtactaagtagttagggttagttagggttacggtaccgtaacccggttacgtaccgtttacggaccggtaacgggggtaacccgtaaaggggtcgggaaggtaacgttaccggaaagggtaaaccgttaaaccggttgggtacgggttaccgttcgggacccgtaaccctagttccgttacggttcctttacctaacgtttccccgttaaccccg

SEQ ID NO: 324196 - DNA, 537 bp, Homo sapiens
  misc_feature: GZ8MTXP01EVF81.21.38.D05.1.454.CMB.2.raw
  modified_base (204)..(204): a, c, t, g, unknown or other
  misc_feature (204)..(204): n is a, c, g, or t
  modified_base (392)..(392): a, c, t, g, unknown or other
  misc_feature (392)..(392): n is a, c, g, or t
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
  modified_base (500)..(500): a, c, t, g, unknown or other
  misc_feature (500)..(500): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctccaggtgtcaccggagaagttgtcttgacgcagtctccaggcaccctgtctctgtctccgaaggggaaangttactctctcctgcaaggccagtcagagtgttggcatcgacgttgcctggtaaccaacaaaaacctggccaggctcccagtctcctcatctatggggcatcctacaggatgaccggcatcccagacaggttcagtgccagtgggtctggggacagaacttcaactctcaccatacaacacactggcncctgaagtattttgactagttgtattactgtcagntggtatgggtagtcaccgtacncgtttggaccgtaggggaccaagggtcgagaatcgagacgaacgtggtggnttcgctaaccgatctgtcttctaacttccgttccccg

SEQ ID NO: 324197 - DNA, 543 bp, Homo sapiens
  misc_feature: GZ8MTXP01AU4XJ.21.38.D05.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (393)..(393): a, c, t, g, unknown or other
  misc_feature (393)..(393): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttacnctctcctgcaaggccagtcagagtgttggcatcgacgttgcctggtaccaacaaaactggccaggctccagtctcctcatctatggggcatcctacaggatgaccggcactcccagacaggttcagtgccccgaggtgggtctgggacaagacttcactctcaccatcaacacactggccnctagaagtatttgactagttgtattacgtgtcagagtgtagtggtacgtcaccgtctacgtttggccgtagggggtaccagggtggaagagttcgagacgaactggttaggcgttgaaccgactaatcgtcgttacttcgaactttcccg

SEQ ID NO: 324198 - DNA, 529 bp, Homo sapiens
  misc_feature: GZ8MTXP01BKPCB.21.38.D05.1.454.CMB.2.raw
  modified_base (201)..(201): a, c, t, g, unknown or other
  misc_feature (201)..(201): n is a, c, g, or t
  modified_base (276)..(276): a, c, t, g, unknown or other
  misc_feature (276)..(276): n is a, c, g, or t
  modified_base (318)..(318): a, c, t, g, unknown or other
  misc_feature (318)..(318): n is a, c, g, or t
  modified_base (395)..(395): a, c, t, g, unknown or other
  misc_feature (395)..(395): n is a, c, g, or t
  modified_base (428)..(428): a, c, t, g, unknown or other
  misc_feature (428)..(428): n is a, c, g, or t
  modified_base (478)..(478): a, c, t, g, unknown or other
  misc_feature (478)..(478): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaacctggccaggcncccagtctcctcatctatggggcatcctacaggatgaccggnactcccagacaggttcagtcgccagtggggtctggggacaggtaacttcaactctacaccatacaacacactggacncctagaagtattttgactagttgtattactgtnagatggtatggttagcaccgtcacgtttggaccgtaggggaccaaggtgngaatcgagacgacgtgtgcgttgcaaccatctgtcttcaacgttcctcccg

SEQ ID NO: 324199 - DNA, 644 bp, Homo sapiens
  misc_feature: GZ8MTXP01DG426.21.38.D05.1.454.CMB.2.raw
  modified_base (204)..(204): a, c, t, g, unknown or other
  misc_feature (204)..(204): n is a, c, g, or t
  modified_base (282)..(282): a, c, t, g, unknown or other
  misc_feature (282)..(282): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctaggtaaccaaacaaaacctggaccaggcncccagtctcctcatctagtgggcatcctacaggatcgaccggcactcccaagacgtagttcagtcgcctaggtgggtctggggacagtaaccttcaactctacaaccataccaacacactggcnctagaagtntttagctagttgtattacngtacagtagttagggttagttggggttaacgtaccgtaaccgttaaccgtaccgttttcgggaacccggtaaaggggggtaaccctaaagggggtagggtaagtaaacgttacggaaacgggtaaacgttaaacggttgggtaacggcgttacggacctaaccggtattccgttcggttaccttacctaaccgtttcccgttaacccccg

SEQ ID NO: 324200 - DNA, 557 bp, Homo sapiens
  misc_feature: GZ8MTXP01AM5AX.21.38.D05.1.454.CMB.2.raw
  modified_base (207)..(207): a, c, t, g, unknown or other
  misc_feature (207)..(207): n is a, c, g, or t
  modified_base (409)..(409): a, c, t, g, unknown or other
  misc_feature (409)..(409): n is a, c, g, or t
  modified_base (535)..(535): a, c, t, g, unknown or other
  misc_feature (535)..(535): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctaggtaccaacaaaacctggccaggctcccagtctcctcatctagtggggcatcctacgaggatcgaccggcactcccagacaggttcagtcgcccaggtgggtctggggacaagacttcactctacaccatacaacacactgcgctgaagttntttgactagtgtattacgtgtacagagttgtagtgggtacgtccaccgtactaccgtttgggaccgtagggggaccaagggtcggaagtacgttcgaaggacgtaacgtggttggcttggcaccgnttctgttcctcttaacgttccc

SEQ ID NO: 324201 - DNA, 536 bp, Homo sapiens
  misc_feature: GZ8MTXP01BVVFO.21.38.D05.1.454.CMB.2.raw
  modified_base (201)..(201): a, c, t, g, unknown or other
  misc_feature (201)..(201): n is a, c, g, or t
  modified_base (509)..(509): a, c, t, g, unknown or other
  misc_feature (509)..(509): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccacaaaacctggccaggctcccagtctcctcatctatggggcatcctacaggatgaccggcatcccagacaggttcagtgccagtgggtctgggacagaacttcgaactctcaccatcaacacactggcgcctgatattttgactagttgtattactgtcagtatggtattgggtaggtctaccgtacaccgtttggaccgtagggggacccaagggttcgggagaatccaggacgaacgtggtggccttggcnccatctggtcttcgaacttcttccccg

SEQ ID NO: 324202 - DNA, 552 bp, Homo sapiens
  misc_feature: GZ8MTXP01CFOWD.21.38.D05.1.454.CMB.2.raw
  modified_base (206)..(206): a, c, t, g, unknown or other
  misc_feature (206)..(206): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgtggcatcgagttgcctgtaccaacaaaaacctggccaggctcccagtctcctcatctatggggcatcctacaggatgaccggcatcccagacaggttcagtgccccaggtggtctgggacagacttcactctcaccatcaacacactggcgcctgaagtattttagactagtgtaattactgtcagtatgtagtggtacggtcacccgtatccgtttaggccgtaagggggaccaagggtggaagattgaaggttacgaaacgtggttacgggcttggaacctaccgaattcgtagttcttccgaagtttccccg

SEQ ID NO: 324203 - DNA, 611 bp, Homo sapiens
  misc_feature: GZ8MTXP01A1SPV.21.38.D05.1.454.CMB.2.raw
  modified_base (203)..(203): a, c, t, g, unknown or other
  misc_feature (203)..(203): n is a, c, g, or t
  modified_base (276)..(276): a, c, t, g, unknown or other
  misc_feature (276)..(276): n is a, c, g, or t
  modified_base (368)..(368): a, c, t, g, unknown or other
  misc_feature (368)..(368): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaangttactctctcctgcaaggccagtcagagtgtggcatcgagttgcctaggaaccaacaaaacctggccaggcncccagtctcctcatctagtgggcatcctacgaggatcgaccggcactcccagacaggttcagtgccgaggtgggtctgggacagtaacttcnctctcaccataccaacacacgtcggcctcctagaagttattttgactaggttgtattacgtgtacagtagttgggttaaggttgggttaacggtacctaaccgttaccgtacccggtttgggacccggtaacgggggtaacccgtaaggggtcggaagtaacgtacgaaggtaaccgaagtggtcggccgttcggacctaacctagttccgttcgttcttacctaacgttcccgttaaccccg

SEQ ID NO: 324204 - DNA, 552 bp, Homo sapiens
  misc_feature: GZ8MTXP01AFY9X.21.38.D05.1.454.CMB.2.raw
  modified_base (203)..(203): a, c, t, g, unknown or other
  misc_feature (203)..(203): n is a, c, g, or t
  modified_base (277)..(277): a, c, t, g, unknown or other
  misc_feature (277)..(277): n is a, c, g, or t
  modified_base (363)..(363): a, c, t, g, unknown or other
  misc_feature (363)..(363): n is a, c, g, or t
  modified_base (387)..(387): a, c, t, g, unknown or other
  misc_feature (387)..(387): n is a, c, g, or t
  modified_base (537)..(537): a, c, t, g, unknown or other
  misc_feature (537)..(537): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccgggagaagttgtcttgacgcagtctccaggcaccctgtctctgtctccgaggggaaangttactctctcctgcaaggccagtcagagtgttggcatcgacgttgcctggtaccaacaaaacctggccaggcncccagtctcctcatctatggggcatcctacaggatgaccggcatcccagacaggttcagtgccagtgggtctgggacagaacttcnctctccaccatcaacacactggcncctgaagtatttgacagttgtattacgtgtacagatggggtatgggtagtcctaaccgtacaccgtttgggacccgagggggtaccaagggtggaagaatacgagtacgaacgtggtggcgttggcctaacgcttcgtacgtcctttacncgttcccgttccccg

SEQ ID NO: 324205 - DNA, 567 bp, Homo sapiens
  misc_feature: GZ8MTXP01BEXFI.21.38.D05.1.454.CMB.2.raw
  modified_base (203)..(203): a, c, t, g, unknown or other
  misc_feature (203)..(203): n is a, c, g, or t
  modified_base (277)..(277): a, c, t, g, unknown or other
  misc_feature (277)..(277): n is a, c, g, or t
  modified_base (370)..(370): a, c, t, g, unknown or other
  misc_feature (370)..(370): n is a, c, g, or t
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
  modified_base (465)..(465): a, c, t, g, unknown or other
  misc_feature (465)..(465): n is a, c, g, or t
  modified_base (538)..(538): a, c, t, g, unknown or other
  misc_feature (538)..(538): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaangttactctctcctgcaaggccagtcagagtgttggcatcgagttgcctggtaaccaacaaaacctggccaggcncccagtctcctcatctagtgggcatcctacaggatgaccggcactcccagacaggttcagtgccgaggtcggggtctggggacagtaacttcnctctcaccatacaacacactcggccgcctaggaattntttagactaggttntatactgtacagtnttggtattgggtaacgtccgaaccgttacnccgtttggaccggaaggggtaccaagggtacggacgaatcgagaacgaagttggaggttcgttagcctaactntcgtgtaccttcgaacgtttccctccccg

SEQ ID NO: 324206 - DNA, 564 bp, Homo sapiens
  misc_feature: GZ8MTXP01A1GM7.21.38.D05.1.454.CMB.2.raw
  modified_base (205)..(205): a, c, t, g, unknown or other
  misc_feature (205)..(205): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (533)..(533): a, c, t, g, unknown or other
  misc_feature (533)..(533): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaangttactctctcctgcaaggccagtcagagtgttggcatcgacgttgcctaggtaaccaacaaaacctggccaggctcccagtctcctcatctatggggcatcctacaggatgaccggcactcccagacaggttcagtcgccaggtgggtcgtgggacaggaacttcaactctacaccatcaacacacncggcnccgtagaagtatttgactagttgtattactgtactagtatgggtagtgggtagtctaccgtacacgttggacgtacggggaccaagggtggagaagtcgaggaacgttacgtaggtcggcgttcgaccgtaactntcgttcgttcttctaacgttcccgttccccg

SEQ ID NO: 324207 - DNA, 579 bp, Homo sapiens
  misc_feature: GZ8MTXP01AB93Y.21.38.D05.1.454.CMB.2.raw
  modified_base (202)..(202): a, c, t, g, unknown or other
  misc_feature (202)..(202): n is a, c, g, or t
  modified_base (363)..(363): a, c, t, g, unknown or other
  misc_feature (363)..(363): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctcaggggaaangttactctctcctgcaaggccagtcagagtgttggcatcgacgttgcctaggtaaccaacaaaacctggccaggctccagtctctcatctagtgggcatcctacaggatcgaccggcactcccagacaggttcagtgccagtggtctgggacagaacttcnctctacacatcaacacactcggctcctagtaacgtatttgactagttagtattacgtgtacagtatggtagtgggtagtactaaccgtctacgttcggaccgaaggggtaaccaagggtcggaagtaacgtacgaaggacgttaaacgttcggtacggttcgttcggacctaacctacttcgttacgttccttactaaccgttcccgttaaccccg

SEQ ID NO: 324208 - DNA, 570 bp, Homo sapiens
  misc_feature: GZ8MTXP01BZOO8.21.38.D05.1.454.CMB.2.raw
  modified_base (203)..(203): a, c, t, g, unknown or other
  misc_feature (203)..(203): n is a, c, g, or t
  modified_base (396)..(396): a, c, t, g, unknown or other
  misc_feature (396)..(396): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaangttactctctctgcaaggccagtcagtagtgttggcatcgagttgcctggtaaccaacaaaactgccaggctccagtctcctcatctatgggcatcctacaggatcgaccggcactcccagacgaggttcagtcgccaggtgggtcgtgggacacggtaacttcaacctcactaccactacaacacacgtgcnccgtagagtatttgactagtgtattacgtgtacgtagtataggtagttggggtacgtaccgtaccgtacgtaccgtttcggaccgtaggggtaaccgaagggtggaagaatacgagtaacgaagtcggtaggcttgaccaactattcgtagtcttactaacttcgttaaccccg

SEQ ID NO: 324209 - DNA, 705 bp, Homo sapiens
  misc_feature: GZ8MTXP01A3GZU.21.38.D05.1.454.CMB.2.raw
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaatgttactctctcctgcaaggccagtcagagtgttggcatcgacgttgcctaggtaaaccaaacgaaaacctcggaccaggcctcccagtcctcctcatctagtgggcatcctacgaggatacggaccggcactcccgaagaccgtaggttcagtcgccgtaggtgggtacgtgggacacggtaaccttcaacctctaccacctactaccaaacacgtaccgtggaccgtaccgtaaggaacttagttttcggacttaagggttacttaatttacgttagttacgaagttaattagggggttacgttaggggttaacggtacccgtaacccggttaaccgttacccgggttttacgggaacccgggtaacgggggtaacccgtaaggggttacgggaaagtaacgttaacgaacgggtaaccgttaaacgttcgggttacggacgttcggacctaacccggtattccgtttaggtcctttaccctaacgtttccccgttccccg

SEQ ID NO: 324210 - DNA, 645 bp, Homo sapiens
  misc_feature: GZ8MTXP01BGPKS.21.38.D05.1.454.CMB.2.raw
  modified_base (203)..(203): a, c, t, g, unknown or other
  misc_feature (203)..(203): n is a, c, g, or t
  modified_base (419)..(419): a, c, t, g, unknown or other
  misc_feature (419)..(419): n is a, c, g, or t
tcagtcgtcgctcgcacgaccggtgctcgatttagtatctgatagttgggtttgggggaagagctgctcagttaggacccagagggaaccatggaaaccccagcgcagcttttcttcctcctgctactctggctccaggtgtcaccggagaagttgtcttgacgcagtctccaggcaccctgtctctgtctccgaggggaaangttactctctcctgcaaggccagtcagtagtgtggcatcgacgttgcctaggtaaccaaacaaaaccgtggaccaggcctcccagtctcctcatctagtcgggcatcctacaggatcgacgcactccagactaggttcagtcgcgtaggtcggtcgtagggactagtacttcgactctacaaccatacaacacgacgtcggacgtctagaaagttntttaggctaaggttacgttaattactagtactaagtagttaggtaggggttacggttacggtaccgaaccggttaacgtacccgtttcgggaccggtaacgggggtaacctaaaggggtaggaacgtacgtaacggaaacggaacggtaacgttgggtacggcgttacggacttacccgtaatcccgttcggttaccttcttaacgttcccgtttccccggtaacc

SEQ ID NO: 324211 - DNA, 550 bp, Homo sapiens
  misc_feature: GZ8MTXP01AQIAD.21.38.D05.1.454.CMB.2.raw
  modified_base (202)..(202): a, c, t, g, unknown or other
  misc_feature (202)..(202): n is a, c, g, or t
  modified_base (434)..(434): a, c, t, g, unknown or other
  misc_feature (434)..(434): n is a, c, g, or t
  modified_base (491)..(491): a, c, t, g, unknown or other
  misc_feature (491)..(491): n is a, c, g, or t
  modified_base (498)..(498): a, c, t, g, unknown or other
  misc_feature (498)..(498): n is a, c, g, or t
  modified_base (524)..(524): a, c, t, g, unknown or other
  misc_feature (524)..(524): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctaggtaaccaacaaaaacctggccaggctcccagtctcctcatctagtggggcatcctacaggatcgaccggcatcccagacaggttcagtgccaggtcgggtctggggacaggtaacttcgaactctccacatacaacacactgacgcctagaagtatttgactagtgtattactgtacagtnttgggtagtggtacgtctaccgtactaccgtttggaccgtaggggtaccaagggtgngtaactnaggtacgacgtggtgcttgcctaacntctgtcttctaacgttcgtaaccccg

SEQ ID NO: 324212 - DNA, 548 bp, Homo sapiens
  misc_feature: GZ8MTXP01A91MZ.21.38.D05.1.454.CMB.2.raw
  modified_base (200)..(200): a, c, t, g, unknown or other
  misc_feature (200)..(200): n is a, c, g, or t
  modified_base (389)..(389): a, c, t, g, unknown or other
  misc_feature (389)..(389): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctccaggtgtcaccggagaagttgtcttgacgcagtctccaggcaccctgtctctgtctccaggggaaangttactctctcctgcaaggccagtcagagtgttggcatcgacgttgcctaggtaaccaaacaaaacctggccaggctcccagtctcctcatctagtgggcatcctacaggatgaccggcatcccagacaggttcagtgccaggtgggtctggggacagaacttcaactctcacatacaacacactggcncctagaagtattttgactagttgtaattactgtcagtagttggtatgggtacgtcaccgtacaccgtttggaccgaggggtaccaagggtcgaagtgtacaggtacgaaacgtggtggacttcggctaacatctcgtcttactaacttccgtaaccccg

SEQ ID NO: 324213 - DNA, 530 bp, Homo sapiens
  misc_feature: GZ8MTXP01EKW4Q.21.38.D05.1.454.CMB.2.raw
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
  modified_base (281)..(281): a, c, t, g, unknown or other
  misc_feature (281)..(281): n is a, c, g, or t
  modified_base (352)..(352): a, c, t, g, unknown or other
  misc_feature (352)..(352): n is a, c, g, or t
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaangttactctctcctgcaaggccagtcagagtgtggcatcgacgttncctaggtaaccaaacaaaaacctggaccaggcncccagtctcctcatctagtgggcatcctacaggatgaccgcatcccagacaggttcagtgccaggtgggtntgggacaggaacttcaactctacaccatacaaacacactgggcacctagaatntttgactagttgtattacngtanagtatggtatggtagtcacgtacacgttggaccgtagggaccaaggtggaagaatgagaacgttagtgtaggcttgcaactntctntcttctcttccgtccg

SEQ ID NO: 324214 - DNA, 616 bp, Homo sapiens
  misc_feature: GZ8MTXP01A5BTP.21.38.D05.1.454.CMB.2.raw
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaatgttactctctcctgcaaggccagtcagagtgtggcatcgacgttgccttaggtaccaaacaaaaccgtggaccaggcctacccgagtcctcctacatctagtgggctactcctacgaggatcggaccgcactcccagacgtaggttcagtcgccccgtaggtggtcgtggacaagtaccttcactcacaccatacaacacactggcnctagaagttntttacgatacgttagttacttacgtgtacagtgtagtagttgggtacgtcgtaaccgttacgtaccggtttacggaccgtaagggggtacctaaggggtgaacgtacgttacgaacgggacgtaaacgtggttacggttcgttacggtaaccacgtaattccgtacggttccttaaccgttaactttccccg

SEQ ID NO: 324215 - DNA, 569 bp, Homo sapiens
  misc_feature: GZ8MTXP01DW9C9.21.38.D05.1.454.CMB.2.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
  modified_base (400)..(400): a, c, t, g, unknown or other
  misc_feature (400)..(400): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctccaggtgtcaccggagaagttgtcttgacgcagtctccaggcaccctgtctctgtctccaggggaaangttactctctcctgcaaggccagtcagagtgttggcatcgacgttgccctaggtaccaacaaaacctggccaggctccagtctcctcatctatgggcatcctanaggatgaccggnactcccagactaggttcagtcgaccccaggtgggtctaggggacaacgacttcactctaccacactacaacacactggcnctgaacgtattttgctagtgtattactgtacagtagttgttagtgggtacgtacaccgtactaccgtttaggccgtaaggggacctaagggtgggaatagttacgaaggttacgtaaacgtgggttacggcttcggctaacctaattcgtgttactttcaactttcccg

SEQ ID NO: 324216 - DNA, 526 bp, Homo sapiens
  misc_feature: GZ8MTXP01D6MJW.21.38.D05.1.454.CMB.2.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (271)..(271): a, c, t, g, unknown or other
  misc_feature (271)..(271): n is a, c, g, or t
tcagtcgtcgctcgcacgaccggtgctcgatttagtatctgatagttgggtttgggagagctgctcagttaggaccagagggaaccatggaaacccagcgcagcttctcttcctcctgctactctggctcccaggtgtcaccggagaagttgtcttgacgcagtctccaggcaccctgtctctgtctccaggggaaanagttactctntcctgcaaggccagtcagagtgttggcatcgacgttgcctggtaccaacaaaacctgcaggcncccagtctcctcatctatggggcatcctacaggatgaccggcatcccagacaggttcagtgccaggtgggtctggggacagaacttcaactctcacccatcaacacactggcgcctagaagtattttgcagttgtattactgtcagtatgggtactgggtagtcaccgtacacgtttggccagggggtaccaagggtcggagaatcagacgaacgtgtggcgttgccaacagtctgtcttctaacttccttcccg

SEQ ID NO: 324217 - DNA, 514 bp, Homo sapiens
  misc_feature: GZ8MTXP01BSMGN.21.38.D05.1.454.CMB.2.raw
  modified_base (201)..(201): a, c, t, g, unknown or other
  misc_feature (201)..(201): n is a, c, g, or t
  modified_base (276)..(276): a, c, t, g, unknown or other
  misc_feature (276)..(276): n is a, c, g, or t
  modified_base (362)..(362): a, c, t, g, unknown or other
  misc_feature (362)..(362): n is a, c, g, or t
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
  modified_base (435)..(435): a, c, t, g, unknown or other
  misc_feature (435)..(435): n is a, c, g, or t
  modified_base (490)..(490): a, c, t, g, unknown or other
  misc_feature (490)..(490): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaacctggccaggcncccagtctcctcatctatggggcatcctacaggatgaccggcatcccagacaggttcagtgccagtgggtctgggacagaacttcnctctcacatcaacacactgcnctgaagtntttgactagtntattactgtcagatggtatggtagtcacgtacnccgtttggcctaggggccaaggtggagaatcgagtacgacgtggtgcttgcaacngtctgtcttctaacttcgttcccg

SEQ ID NO: 324218 - DNA, 576 bp, Homo sapiens
  misc_feature: GZ8MTXP01AXYF0.21.38.D05.1.454.CMB.2.raw
  modified_base (206)..(206): a, c, t, g, unknown or other
  misc_feature (206)..(206): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctaggtaccaacaaaacctggccaggctccagtctcctcatctatggggcatcctacaggatgaccggcactcccagacaggttcagtgccccaggtggtctgggacaagacttcgactctcaccatcaaacacactggcgacctagaacgtattttgctagtgttattactgtctaagtatgtagttggtacgtactacccgtactaccgtttcgggaccgtaacgggggacctaagggtggaagagttacgagacgaaacgtggttacgggcttgggaacctaccgtaagttcctggttaccttccgttaacgtttccccg

SEQ ID NO: 324219 - DNA, 609 bp, Homo sapiens
  misc_feature: GZ8MTXP01CH2WX.21.38.D05.1.454.CMB.2.raw
  modified_base (207)..(207): a, c, t, g, unknown or other
  misc_feature (207)..(207): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttgcatcgagttgcctaggtaccaaacaaaacctggccaggctcccagtctcctcatctagtgggcatcctagaggatcgaccggcactcccagacctaggttcagtgccccaggtggtctgggacaagtaccttcactctacaccatacaacacacgtggcacctagtaagtattttgactagttgtaattcgtgtactagtagtagttacgtgggttaggtacctaccgttacgtaccgtttacgggccgtaagggggacctaaggggtcgggaagtacgttacgaaacggacgtaaacgttgggacgggttccttagggaacccaaccgtaacgttccgtacggtttacctttccgaactttcccccg

SEQ ID NO: 324220 - DNA, 631 bp, Homo sapiens
  misc_feature: GZ8MTXP01ANNXN.21.38.D05.1.454.CMB.2.raw
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgttcacggaaggaatactactctctcgtgacgacgctagtcagtgttgtcgatagtacgtagtcgcgtacgtaaaccaaactaacgtcgacgacgtcccaccgtactcctcctatacttacgtagggtcggactaccgtaccgtaacggagtacgtaccggaccgactaccgtacccgaagtacgtacgttacgagtcgacgtagggtcggtcggtacgacacgtactactctctaccactactaccaacactacggtcgacctacgtagaatttgttacgacgttaggttattaccttagtactagtagttagttagggtaggttacggggtactaccgtaccgtacgttcggttcgaacgggtacggtaacgtagggtcgaatccgagaacggacttaggtgcgcgttcacctaatgtctcgtcttactccgttcccgtaacc

SEQ ID NO: 324221 - DNA, 516 bp, Homo sapiens
  misc_feature: GZ8MTXP01E1TB0.21.38.D05.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (391)..(391): a, c, t, g, unknown or other
  misc_feature (391)..(391): n is a, c, g, or t
  modified_base (471)..(471): a, c, t, g, unknown or other
  misc_feature (471)..(471): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttacnctctcctgcaaggccagtcagagtgttggcatcgacgttgcctggtaccaacaaaaacctggccaggctcccagtctcctcatctatggggcatcctacaggatgaccggcatcccagacaggttcagtgccccagtgggtctgggacaagacttcactctcacatcaacacactggcncctgagtatttgcatgtattactgtcagatgtatggtaagcaccgtcacctttggccagggggtaccaaagggtggaagnttcagacgaaacgtgttgcttgcaccaatctgttcttcaatcccg

SEQ ID NO: 324222 - DNA, 607 bp, Homo sapiens
  misc_feature: GZ8MTXP01AV7YH.21.38.D05.1.454.CMB.2.raw
  modified_base (203)..(203): a, c, t, g, unknown or other
  misc_feature (203)..(203): n is a, c, g, or t
  modified_base (278)..(278): a, c, t, g, unknown or other
  misc_feature (278)..(278): n is a, c, g, or t
  modified_base (575)..(575): a, c, t, g, unknown or other
  misc_feature (575)..(575): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaacctggccaggcncccagtctcctcatctatgggcatcctacaggatgaccggcactcccagacaggttacagtgccaggtgggtctggggacagaacttcaactctacaccatacaacacaactggtacgcctaggaacgtatttttgacgtagttacgttaatttactagttacagtattaggggtagttaggggttacgtcgtaaccggttacctaccgtttggacccggtaacgggggaacccaaaggggttacgggagtaacgtacgaaggacgttaaacgtgggtaaggcgttgaccaaccgtntaacgttgtcttacgtaacttcccgttccccg

SEQ ID NO: 324223 - DNA, 737 bp, Homo sapiens
  misc_feature: GZ8MTXP01EL10L.21.38.D05.1.454.CMB.2.raw
  modified_base (207)..(207): a, c, t, g, unknown or other
  misc_feature (207)..(207): n is a, c, g, or t
  modified_base (311)..(311): a, c, t, g, unknown or other
  misc_feature (311)..(311): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccagggggaaangttactctctcctgcaaggccagtcagagtgttggcatcgagttgcctaggtaccaacaaaacctggacaggctcccagtctcctcatctagtgggcatcctanagatagaccggcactcccagacaggttcaggtcgcccgaggtcgggtacgtcgggactaacgggtaacttccgaacttcctaccacctaattaccaaactaccgtaaccgttcggaccggtaccgtagtaaacggttaacttttttacggaccgttaaaggtttaggttaaactttaccggttacgttaacgtaacggttaacggtttggtttaaaaggttcgggggtttaaaccgggttaacccgttaaaccccggttaacccgttttaaaccggtttccggggaaccggaaccgggggttaaccgaaagggggttcggaaagtacgttacggaaacgggaacgtaaacgttgggttcccgttagttccgggaacctacccttaagttacccgttacggttacctttccggaacgttttcccccg

SEQ ID NO: 324224 - DNA, 574 bp, Homo sapiens
  misc_feature: GZ8MTXP01C4UIB.21.38.D05.1.454.CMB.2.raw
  modified_base (282)..(282): a, c, t, g, unknown or other
  misc_feature (282)..(282): n is a, c, g, or t
  modified_base (347)..(347): a, c, t, g, unknown or other
  misc_feature (347)..(347): n is a, c, g, or t
  modified_base (420)..(420): a, c, t, g, unknown or other
  misc_feature (420)..(420): n is a, c, g, or t
  modified_base (510)..(510): a, c, t, g, unknown or other
  misc_feature (510)..(510): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcacctgtctctgtctcgaggggaaatgttactctctcctgacaaggccagtcagtagtgttgcatcgacgttgcctaggtaaccaaacaaaaacctggaccaggcncccagtcctcctcatctagtgggcatcctacaggatgaccggcatcccagactaggttacaggtncctaggtcgggtactgggacacgtaacttcaactctacaacataccaaacacacttggcgaccgtagaaagtntttagactagtgtattactgtacagtataggggttaatcgggtagtactaccgtacaccgtttcggaccggtagggaaccagggtcgganaactcgaagtacgttaactgtgggccttgacaaccgattctcgtcttataacttccgtaacccg

SEQ ID NO: 324225 - DNA, 656 bp, Homo sapiens
  misc_feature: GZ8MTXP01A7E03.21.38.D05.1.454.CMB.2.raw
tcagtcgtcgctcgcacgaccggtgctcgatttagtatctgatagttgggtttgggggaagagctgctcagttaggacccagagggaaccatggaaaccccagcgcagcttctcttcctcctgctactctggctccaggtgtcaccggagaagttgtcttgacgcagtctccaggcaccctgtctctgtctccgaggggaaatagttactctctcctgcaaggccagtcagagtgttggcatcgtacgttgcctaggtaaaccaaacaaaaccgtcggaccaggcctcccagtcctcctcatctagtggggctactcctacgaggtacgtcggaccggcactcccgaagtacgtaggttcagtcgccgtaggtgggtacgtgggactagtaaccttcgaactcctaccacctaactaccaaactactacgtcggccgtaccgtaggtaacgttagttttacgacgttaagttgttaacttacgtgtacgtagtagttggttaagtagggtacgtaccgtaaccgtactaccggtttacgggaccggtaggggaaccgtagggtcggaagtaacgtacgacggtaaacgttacgtgggtacgcgttcgacgtaacctagttcgttcgttaccgttactaaccgtttcccgtaacccg

SEQ ID NO: 324226 - DNA, 605 bp, Homo sapiens
  misc_feature: GZ8MTXP01EDODG.21.38.D05.1.454.CMB.2.raw
  modified_base (207)..(207): a, c, t, g, unknown or other
  misc_feature (207)..(207): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgacaaggccagtcagagtgttggcatcgacgttgcctaggtaaccaaacaaaaccgtggaccaggcctcccagtctcctacatcgtagtgggactatcctacgaggactcgaccggcacctcccagactacggttcacgtcgccccgaggtggtacgtagggacaacgtacttcgtaactctaccactactacaacacacgtcggcgtacctagtaagttagtttgacttagttagttacttacgtgtacagtagttagtagttggtacgtacgtaaccgttactacgttcggacgtacgggtacgtagggtgaagtacttagaacggttacgtaacgtggttacggcttacgcctacgaacttgtcttacttcaacgttccccg

SEQ ID NO: 324227 - DNA, 618 bp, Homo sapiens
  misc_feature: GZ8MTXP01EUWK0.21.38.D05.1.454.CMB.2.raw
  modified_base (318)..(318): a, c, t, g, unknown or other
  misc_feature (318)..(318): n is a, c, g, or t
  modified_base (429)..(429): a, c, t, g, unknown or other
  misc_feature (429)..(429): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaatagttactctctcctgcaaggccagtcagagtgttggcatcgtacgttgcctaggtaaccaaacgaaaaacctggaccaggcctcccagtcctcctacatctagtgggcatcctanaggatgaaccgcatcccagacgagttcagtcgaccgaggtcggggtactggggacacggtaaccttcaacctctacacctactacaacacacgtggctctagaaacgtttnttcgatagttagttatacgtgtagtaagtagttagggttaggtacggttacgtaccgtaaccgttaccgttacggttacggaaccggaaggggtaaccgtaagggagacgtaacgtacgaaggtacgttacgtggtcgcgttacgaccctaagtcttcgttcgttccttactaacccgttcccgtcccg

SEQ ID NO: 324228 - DNA, 672 bp, Homo sapiens
  misc_feature: GZ8MTXP01AVHWB.21.38.D05.1.454.CMB.2.raw
  modified_base (205)..(205): a, c, t, g, unknown or other
  misc_feature (205)..(205): n is a, c, g, or t
  modified_base (316)..(316): a, c, t, g, unknown or other
  misc_feature (316)..(316): n is a, c, g, or t
tcagtcgtcgctcgcacgaccggtgctcgatttagtatctgatagttgggtttgggggaagagctgctcagttaggacccagagggaaccatgggaaaccccagcgcagcttctcttcctcctgctaatctggctcccaggtgtcaccggagaagttgtcttgacgcagtctccaggcaccctgtctctgtctccgaggggaaangttactctctcctgcaaggccagtcagagtgttggcatcgacgttgccgtaggtaacccaacaaaaccgtggaccaggcctccagtctcctcatctagtgggctatcctanaggatcgaccgcactcccgagacgtacggttacaggtcgccgtaggtcgggtactaggggacacggtaaccttccgaactctaccaaccactaccaacactacgtcggaccgtcctagtaaagttacttttagaccgttagttagttacttacgttagtacgtagttacgttgggttaaggttacgggttaacggttaccgtaacccggttaacccgtaccggttttacggggaacccggtaagggggtaaccctaaaggggttcggaaacggtaacttaccggaagtaaaccggttaacgtggtcgacgttcgacctaaccgatcgttcgtcttacgtaacttcccgttaacccg

SEQ ID NO: 324229 - DNA, 658 bp, Homo sapiens
  misc_feature: GZ8MTXP01BX9FI.21.38.D05.1.454.CMB.2.raw
  modified_base (327)..(327): a, c, t, g, unknown or other
  misc_feature (327)..(327): n is a, c, g, or t
tcagtcgtcgctcgcacgaccggtgctcgatttagtatctgatagttggggtttgggggggagaagagctgctcagttaggacccagagggaaccatggaaaccccagcgcagcttctcttcctcctgctactctggctcccaggtgtcaccgggagaagttgtcttgacgcagtctccaggcaccctgtctctgtctccgaagggggaaatagttactctctcctgacaaggccagtcagtagtgttggcatcgacgttgcctaggtaaccaaacaaaaccgtggaccaggcctcccagtcctcctcatctagtgggcatccgtanaggatacgaccggcactccaagactaggttacagtcgccccgaggttcgggtcgtcggggactaacgtaccttctactcctaccaaccactacaaacactacgtcggcgtacctagtaaacgtattttacgacgttaagtcgttaacttacgtagtactaaggtagttgttaagtggttaacgtcgtaaccgttaccgtaacgttaccgggtaccgaacgggggttaaccgaaagggtagggtaagacgttacgtaacggaacgtaaacggtcggttacgggcttcggaacctacgtaacttcggttacttccttaacgttaactttcccg

SEQ ID NO: 324230 - DNA, 590 bp, Homo sapiens
  misc_feature: GZ8MTXP01A4GEA.21.38.D05.1.454.CMB.2.raw
  modified_base (203)..(203): a, c, t, g, unknown or other
  misc_feature (203)..(203): n is a, c, g, or t
  modified_base (278)..(278): a, c, t, g, unknown or other
  misc_feature (278)..(278): n is a, c, g, or t
  modified_base (366)..(366): a, c, t, g, unknown or other
  misc_feature (366)..(366): n is a, c, g, or t
  modified_base (390)..(390): a, c, t, g, unknown or other
  misc_feature (390)..(390): n is a, c, g, or t
  modified_base (420)..(420): a, c, t, g, unknown or other
  misc_feature (420)..(420): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaacctggccaggcncccagtctcctcatctagtgggcatcctacaggatcgaccggcatcccagacaggttcagtgccaggtgggtctgggacagaacttcnctctcaccatcaacacactcggcncctagaagtatttggactagttgtattacngtacagtatgggtagtggggttagtcctaaccgttacaccgtttggacccggaggggtaacctaaggggtcgaagaacgtacgaacgggtaccgaaagttcgggtaggccgttggacctaacccggtattccgttcggttcctttacgtaaccctttcccgtttcccccg

SEQ ID NO: 324231 - DNA, 573 bp, Homo sapiens
  misc_feature: GZ8MTXP01EWW03.21.38.D05.1.454.CMB.2.raw
  modified_base (255)..(256): a, c, t, g, unknown or other
  misc_feature (255)..(256): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccagggaagagttactctctcctgcaaggccagtcagagtgttggcatcgacgttgtaccgtnncncananacacacgcgacgacgtacctaccgtactcctacctactactacgtacggtacgtactactacgtaccgacgtacgacgaccgacgaaccaccgaacgtacgtacgtacgtacgtacgtacggtacgggtacggtacggtacgacgtacgtactactactacctaccacacacacacgtacgacgacggtacgtagtagttagtacgtagtagtagtactacgtatagtagtagtaagtagttaggtacgttacgtacgtacgttacgttcggacggaacggacggaaggagagacgtaacgaacgtaacg

SEQ ID NO: 324232 - DNA, 789 bp, Homo sapiens
  misc_feature: GZ8MTXP01BVS4W.21.38.D05.1.454.CMB.2.raw
  modified_base (283)..(283): a, c, t, g, unknown or other
  misc_feature (283)..(283): n is a, c, g, or t
  modified_base (388)..(388): a, c, t, g, unknown or other
  misc_feature (388)..(388): n is a, c, g, or t
tcagtcgtcgctcgcacgaccggtgctcgatttagtatctgatagttgggtttgggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaatgttactctctcctgcaaggccagtcagagtgttggcagtcgacgttgcctaggtaaaccaaacaaaacctggccaggcnccccagtctcctcatctagtgggcaactcctacaggactacgaccggcactcccagacgtagtcagcgaccgaggtcgggtactggggaactaggtaaccttacncgttacctacctaacccactaaccaaaccgaactaccgtagggacccgtaccgttaaggtaaagttacgttttacgaccgttaaggtttacgtttaaacgtttaacccgttcggttaacgtaaagggtttaacgtttacggggggtttaaaggtttacgggggttaaaccgggtttaacccggttaaacccggtttaacccgttaacccgggtttttaccggggaaaccccggggtaaacggggggggtaaaacccggtaagggggtttaacgggggtaaacgaaacgttaaccgggttaaacggggaaacccggttaaacggtagggttacgggttaccgttcggaccttaacgtacttcgttacggttaccttaccgtaacgtttccccttaaccccgg

SEQ ID NO: 324233 - DNA, 514 bp, Homo sapiens
  misc_feature: GZ8MTXP01EBT5X.21.38.D05.1.454.CMB.2.raw
  modified_base (199)..(199): a, c, t, g, unknown or other
  misc_feature (199)..(199): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (278)..(278): a, c, t, g, unknown or other
  misc_feature (278)..(278): n is a, c, g, or t
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
tcagtcgtcgctcgcacgaccggtgctcgatttagtatctgatagttgggtttggggaagagctgctcagttaggacccagagggaaccatggaaaccccagcgcagcttctcttcctctgctactctggctccaggtgtcaccggagaagttgtcttgacgcagtctccaggcacctgtctctgtctccaggggaaangttactctctcctgcaaggtccagtcagagtgttgcatcgagttncctggtaccaanaaaactggcagctccagtctcncatcatcgggcatcctacaggatgacgcatcccagacagtcagtgccagtggtctgggacngaacttnaacttnacaccatcaaacgcactggcncctagaagtattcgtacagtatatactagtanagtagtaggtagtaggtacgtacgaccgtacgtacgttacggtacgacggtacgaaggtagagaatacgagacgacgtgtgcgttcacaanatctntcttctcttcgtc

SEQ ID NO: 324234 - DNA, 585 bp, Homo sapiens
  misc_feature: GZ8MTXP01AIOAY.21.38.D05.1.454.CMB.2.raw
  modified_base (209)..(209): a, c, t, g, unknown or other
  misc_feature (209)..(209): n is a, c, g, or t
  modified_base (424)..(424): a, c, t, g, unknown or other
  misc_feature (424)..(424): n is a, c, g, or t
  modified_base (541)..(541): a, c, t, g, unknown or other
  misc_feature (541)..(541): n is a, c, g, or t
tcagtcgtcgctcgcacgaccggtgctcgatttagtatctgatagttgggtttgggggggagaagagctgctcagttaggacccagagggaaccatggaaaccccagcgcagcttctcttcctcctgctactctggctcccaggtgtcaccgggagaagttgtcttgacgcagtctccaggcaccctgtctctgtctccgaggggaaangttactctctcctgcaaggccagtcagagtgttggctatcgacgttgcctaggtaccaacaaaacctggccaggcctccagtcctcctcatctagtggggcatcctacgaggatgaccggcactcccagacaggtcagtcgcccgtaggtgggtcgtgggacaagtaccttcgactcctacaccatcaaacacactcggctaccgtagtaacgtntttagctagttgtacttacgtgtacagagttgtagtggtagtccaccgtactaccggttaggccgtaggggaaccgtagggtggaagacgttgaacgacgtaaacgtggttacggcncggtaaccacttaacgtcttcggttccttcgttaactttccccg

SEQ ID NO: 324235 - DNA, 587 bp, Homo sapiens
  misc_feature: GZ8MTXP01CPFJS.21.38.D05.1.454.CMB.2.raw
  modified_base (209)..(209): a, c, t, g, unknown or other
  misc_feature (209)..(209): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
  modified_base (416)..(416): a, c, t, g, unknown or other
  misc_feature (416)..(416): n is a, c, g, or t
tcagtcgtcgctcgcacgaccggtgctcgatttagtatctgatagttggggtttgggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgacaaggcagtcagagtgttgcatcgacgttgcctaggtaccaacaaaaacctggaccaggctcccagtctcctcatctatgggcatcctanaggatgaccggnatcccagactaggttcagtcgaccccgtaggtggggtcgtggggacctaaaggtacctttcgactcctacaccatacaaacacactggcncctagaacgtatttgactagtgtaattactgtacagattgtagttggtacgtcaaccgtactacgtttacgggacgtaaggggaccgtaagggtcggaagtacttgaagacggtaaacgtggttacggttcacggtccaaccgtaatcttcgttcttaacaagtttccccg

SEQ ID NO: 324236 - DNA, 672 bp, Homo sapiens
  misc_feature: GZ8MTXP01ERXZN.21.38.D05.1.454.CMB.2.raw
  modified_base (305)..(305): a, c, t, g, unknown or other
  misc_feature (305)..(305): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaagtagtttactctctcctgacaaggccagtcagagtgttgcatcgacgttgcctaggtaaccaacaaaacctggaccaggctcccagtctcctcactctagngggcatcctacgaggatgaccggacactcccgagacaggttcagtcgccgaggtcgggtctgggacagtaacttcaactctaccaccataccaacacacgtgcacctagaagtactttgacgtagttgttaacttacgtagtacgtagtaattgggggtaagttacggggttaacgtacccgtaaacggttaacccgtaccgggttttacggacccgggtaacgggggtaaccgtaaaggggtacgggtaagtaacgttaccggaacggtaaaccggttaaacggtcgggtcggttccgttcggaccgtaacccttagttccgtttacgggttcctttacctaaccgtttccccggtttaacccccg

SEQ ID NO: 324237 - DNA, 606 bp, Homo sapiens
  misc_feature: GZ8MTXP01BHGO7.21.38.D05.1.454.CMB.2.raw
  modified_base (202)..(202): a, c, t, g, unknown or other
  misc_feature (202)..(202): n is a, c, g, or t
  modified_base (438)..(438): a, c, t, g, unknown or other
  misc_feature (438)..(438): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctaggtaaccaacaaaacctggccaggctcccagtctcctcatctagtgggcatcctacaggatcgaccggcactccccagtacaggttcagtgccaggtgggtctggggacaggtaaccttcaactctacaacctatacaaaccacacctcggcgacctagaagtattttgactagttgtattacgtntcgagtagttagggtaagttggggttaacggtcctaaccgttaccgtaccgttttcggggacccggtaagggggtaacccaaaggggttcgggaaagtaacttaccgaaggtacgaacgtggtacggcgttcgacctaacgattcgtcgtcttctaacttccgtcccg

SEQ ID NO: 324238 - DNA, 626 bp, Homo sapiens
  misc_feature: GZ8MTXP01BP2V6.21.38.D05.1.454.CMB.2.raw
  modified_base (204)..(204): a, c, t, g, unknown or other
  misc_feature (204)..(204): n is a, c, g, or t
  modified_base (282)..(282): a, c, t, g, unknown or other
  misc_feature (282)..(282): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaanagttactctctcctgcaaggccagtcagagtgttggcagtcgacgttgcctaggtaaccaacaaaacctggccaggcnccagtctcctcatctagtggggcatcctacgaggatcgaccgcactcccagtacgagttcagtcgccgtacggtggggtcgtaggggacaggtaaccttccgaacttcctacaaacccataccaaaccacacgtcggccgcctagaagttagtttgacgtagttagttattacgtgtactagtattggggtagttacgggtacggtccgtaccgttaccgtaccgtttgggacccgtaggggggtaaccctaaggggtcgaaggtaacgtcgaaggaccgttaacgtggtacggcgttcgaccgaacccattccgtgtccttcctaacgttccccgttaacccg

SEQ ID NO: 324239 - DNA, 850 bp, Homo sapiens
  misc_feature: GZ8MTXP01BBOJT.21.38.D05.1.454.CMB.2.raw
  modified_base (203)..(203): a, c, t, g, unknown or other
  misc_feature (203)..(203): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctcgaggggaaangttactctctctgcaagccagtcagtagtggttgcatcgacgttgccgtaggtaaccaaacgaaaaccgtggaccaggcctaccgagtcctcctctactctaggtcggggacctacgtccctagaggagtcggaccggactacgtacccgtagacgtacggttcaacggtcgaccgtagggttcggggtcgtacgggggtaacctacggttaacccttaccgtaaccgttcccgttaacccgaaaccgtaccgttaacccgaaaccaaccgttaaaccggttaccgggccgttaaccccgtaaagggttaaaaccgggttttacgtttaccggtaacgtttaacgggtttacgtttaaaccggtttacggttaacgtaacggttaaggtttaacggtttacgggggttaaacggggttaccggggttaaaccggttaccccggttaaacccggtttaacccggttaacccggggtttaccggggaaacccggggtaacggggtaacgggtaaacggggtacgggtaaacggtaacgtaaacgggaaccgggtaaaccggttacggttacgggtcggttaccgttccggttaaccctaacgttacgttcgttaccgttccgttaccgtaacccgtttcccgtaacccg

SEQ ID NO: 324240 - DNA, 722 bp, Homo sapiens
  misc_feature: GZ8MTXP01BRQVN.21.38.D05.1.454.CMB.2.raw
  modified_base (203)..(203): a, c, t, g, unknown or other
  misc_feature (203)..(203): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaanagttactctctcctgcaaggccagtcagagtgttggcagtcgacgttgcctggtaacccaacaaaacctggccaggctcccagtctctcatctagtgggcatcctacaggatcggaccggcactccccagaccgaggtttccaggtcgcccgtaggtcggggttacgttgggggacctaggaaaccctttctaacctccttaccaaccctattaccaaacccactaaccgtcgggtccgccccgttagtaaaggttacgtttttgaccgttaaggtttgtttaacttacgttacggtctaaggtagtttaggggttaagtttcggggttaaaggttccccgtaacccgggtttaacctacccgggtttttacgggacccggggtaaacgggggtaccgtaaacggggttaggggaaaggtaacgttacggaaacggtacggttaaacgttcgggtgggcgttcggacctaacccgtatcccgttaggttccctttcgtaaccgtttcccttaaccccgg

SEQ ID NO: 324241 - DNA, 559 bp, Homo sapiens
  misc_feature: GZ8MTXP01E0YXH.21.38.D05.1.454.CMB.2.raw
  modified_base (203)..(203): a, c, t, g, unknown or other
  misc_feature (203)..(203): n is a, c, g, or t
  modified_base (279)..(279): a, c, t, g, unknown or other
  misc_feature (279)..(279): n is a, c, g, or t
  modified_base (376)..(376): a, c, t, g, unknown or other
  misc_feature (376)..(376): n is a, c, g, or t
  modified_base (401)..(401): a, c, t, g, unknown or other
  misc_feature (401)..(401): n is a, c, g, or t
  modified_base (521)..(521): a, c, t, g, unknown or other
  misc_feature (521)..(521): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcacctgtctctgtctccgaggggaaangttactctctcctgcaaggccagtcagagtgttggcatcgacgttgcctaggtaaccaaacaaaactggccaggcnccagtctctcatctagtgggcatcctacaggactcggaccggcactcccgagacaggttcagtcgccgtaggtcgggtctaggggacagtaacttcnctctacaccatacaacacactggcnctagaagtctttgactagttagtattactgtacagtatgggtagttgggtagtaccgtacgtactccgtttggaccgtaaggggacctagggtcgagtaatacgagacgacgtgtggacncgctaacgattctcgttcttactaacttcccgttcccg

SEQ ID NO: 324242 - DNA, 564 bp, Homo sapiens
  misc_feature: GZ8MTXP01AGBL8.21.38.D05.1.454.CMB.2.raw
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaagagttactctctcctgcaaggccagtcagagtgttggcatcgacgttgcctggtaaccaanaaaacctggccaggcnccagtctctcatctatgggcatcctacaggatgaccggcactcccaagacaggttcagtcgccgaggtgggtctggggacaggtaacttcaacgtctcaccatcaacacactcgcgcctgaacgtattttcgactagttgtaattactagtcaggtctagggtagttgggtacgtccaaccgtcacgttcggaccgtaagggggtacccaaagggtggaagaactcgaaggtaccgaagtggtaggcttggcaaccgtatcttgtacttcaacgttccctcccg

SEQ ID NO: 324243 - DNA, 730 bp, Homo sapiens
  misc_feature: GZ8MTXP01DBB0Y.21.38.D05.1.454.CMB.2.raw
  modified_base (205)..(205): a, c, t, g, unknown or other
  misc_feature (205)..(205): n is a, c, g, or t
  modified_base (447)..(447): a, c, t, g, unknown or other
  misc_feature (447)..(447): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaanagttactctctcctgcaaggccagtcagagtgttggcagtcgacgttgcctaggtaaccaaacaaaaaccgtggaccaacggctccccagtcctcctacatctagtggggcaacgtcctaagaggactcggaccggacactcccgaagactaggttacagtcgccaggtgggtactgggaacataaccgttcaactcctacaaccataccaacgacacgtcggacctccgtagaaacgtttntttcgacgttagttacgtacttacgtagtaacgtagttagttagggttaaggttacgggttaccgttaccgtaccgttaaccgttacccggttacgggaacccgggtaacgggggtaaaccggtaaggggtacggaaacgttaacgtaacggttaaacgggtaaaccggttaaacgggttacggtaccgggttacccgttcgttaaaccccttaacccgttagttttcccggttccgtttacccgtttacccgttaacccgttttaacccccgtaacccccgg

SEQ ID NO: 324244 - DNA, 681 bp, Homo sapiens
  misc_feature: GZ8MTXP01A945Y.21.38.D05.1.454.CMB.2.raw
  modified_base (339)..(339): a, c, t, g, unknown or other
  misc_feature (339)..(339): n is a, c, g, or t
  modified_base (382)..(382): a, c, t, g, unknown or other
  misc_feature (382)..(382): n is a, c, g, or t
  modified_base (445)..(445): a, c, t, g, unknown or other
  misc_feature (445)..(445): n is a, c, g, or t
  modified_base (654)..(654): a, c, t, g, unknown or other
  misc_feature (654)..(654): n is a, c, g, or t
tcagtcgtcgctcgcacgaccggtgctcgatttagtatctgatagttgggtttgggggggagaagagctgctcagttaggacccagagggaaccatggaaaccccagcgcagcttctcttcctcctgctactctggctccaggtgtcaccggagaagttgtcttgacgcagtctccaggccaccctgtctctgtctccgaaggggaatagttactctctctgcaagccagtcagagttgtgacagtcgacgttgccgtacggtaaccaaaacgaaaaccgtcggacctacggccctacctagtccctctactactcgtagtcggactactaccgtaagngtacgtcggacccggctaaccgtcccgaacgtacgtacggttnacggtcgccgtagggtgggtcaggacctaacgtcttcgactcctacaccctactaccgaaacncctacggtcgacgtcaaggtaattcgtttacgacgttagttaggttacttacgttagacgttaagtaggggttagttacgggttacgggttaccgttaccgaacccgtttccgttacgttacgggggacccgtaaagggggaccgttaaagggcggtaagtacgttccggaaagttacgtacgtggttcggttattcggaactacgttnttacgtccgttatccgtttcgtccccg

SEQ ID NO: 324245 - DNA, 705 bp, Homo sapiens
  misc_feature: GZ8MTXP01CYL65.21.38.D05.1.454.CMB.2.raw
  modified_base (212)..(212): a, c, t, g, unknown or other
  misc_feature (212)..(212): n is a, c, g, or t
  modified_base (320)..(320): a, c, t, g, unknown or other
  misc_feature (320)..(320): n is a, c, g, or t
tcagtcgtcgctcgcacgaccggtgctcgatttagtatctgatagttgggtttgggggggagaagagctgctcagttaggacccagagggaaccatggaaaccccagcgcagcttctcttcctcctgctactctggctccaggtgtcaccggagaagttgtcttgacgcagtctcaggcaccctgtctctgtctccaggggaaagagttacnctctcctgcaaggccagtcagagtgtgcatcgacgttgcctaggtaaccaaacaaaaccgtggccaggcctccagtctcctcactctagtcggggactactccgtaanagggtatacgaccggactactaccccaaggtacacggtttacgaggttcgaccccgtagggtacgggtcggtaggggaacaacggttaaccttccacgttccaacctaacccaataacccgaaacaccgtaacgtcggaccgtaccgtagtaagtttacgtttaggtacctagttagttacttaaccgtgtacgtaagtaggttacgttaggtacggttacggtaccaaccggttacctaccggtttacggaccggtaacgggggtaccaaggggttaggaacgtaacgttacggaaacgaaccggtaagttcgggttacgggcttaccggtaacacccgttaaggttccttaacggttccctttaacgaacccgttttcccccg

SEQ ID NO: 324246 - DNA, 504 bp, Homo sapiens
  misc_feature: GZ8MTXP02F62PO.21.38.D05.1.454.CMB.2.raw
  modified_base (201)..(201): a, c, t, g, unknown or other
  misc_feature (201)..(201): n is a, c, g, or t
  modified_base (408)..(408): a, c, t, g, unknown or other
  misc_feature (408)..(408): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactgcgcctgaagatttgcagtgtattacngtcagatgtatggtagtcacgtacacctttggccaggggaccaaggtgagatcagacgaaatgtggctgcaaccatctgtcttctactctttcccg

SEQ ID NO: 324247 - DNA, 498 bp, Homo sapiens
  misc_feature: GZ8MTXP02H99QU.21.38.D05.1.454.CMB.2.raw
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
  modified_base (462)..(462): a, c, t, g, unknown or other
  misc_feature (462)..(462): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctccaggtgtcaccggagaagttgtcttgacgcagtctccaggcaccctgtctctgtctcagggaaagagttactctctcctgcaaggccagtcagagtgttggcatcgacgttgcctggtaaccaacaaaaacctggcaggctccagtctctcatctatggggcatcctacaggatgaccggcatcccagacaggttcagtgccagtgggtctggacagacttcactctcaccatcaacacactgcgcctgaagatttgcagtgtatactgtcagatgtatggtagtcacgtanaccttggcnggggtaccaaggtgagatcagactaacnggtgctagcaaccgatcctgtcttctactcttcccg

SEQ ID NO: 324248 - DNA, 590 bp, Homo sapiens
  misc_feature: GZ8MTXP02IQYWW.21.38.D05.1.454.CMB.2.raw
  modified_base (201)..(201): a, c, t, g, unknown or other
  misc_feature (201)..(201): n is a, c, g, or t
  modified_base (304)..(304): a, c, t, g, unknown or other
  misc_feature (304)..(304): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctccagtctcctcatctatggggcatcctanaggatgaccggcatcccagacaggttcagtgccaggtgggtctgggacagacttcactctcaccatcaacacactggcncctgaaacgtnttttgactagttgtattacgtgtcagtattagttagttgggttacggtctaacccggtactaccgtttcgggaccgaaagggggtaccaaaaggggtgggaacggtaacttacgaaaggaaccgtaaacgttcggttagggaccttcggacctaaccgtattcgttacgttctttaccaactttccgtttcccccg

SEQ ID NO: 324249 - DNA, 503 bp, Homo sapiens
  misc_feature: GZ8MTXP02HBPSD.21.38.D05.1.454.CMB.2.raw
  modified_base (202)..(202): a, c, t, g, unknown or other
  misc_feature (202)..(202): n is a, c, g, or t
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
tcagtcgtcgctcgcacgaccggtgctcgatttagtatctgatagttgggtttggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctgggacagacttcactctcaccatcaaacncactggcncctgaagtattttgctagtgtattactgtcagtatgtatgtaggtcacgtcactttggccaggggaccaggtgagatcagacgaatgtaggctgcaaccatctgtcttcactcttccc

SEQ ID NO: 324250 - DNA, 509 bp, Homo sapiens
  misc_feature: GZ8MTXP02HTT2C.21.38.D05.1.454.CMB.2.raw
  modified_base (205)..(205): a, c, t, g, unknown or other
  misc_feature (205)..(205): n is a, c, g, or t
  modified_base (381)..(381): a, c, t, g, unknown or other
  misc_feature (381)..(381): n is a, c, g, or t
  modified_base (482)..(482): a, c, t, g, unknown or other
  misc_feature (482)..(482): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgccccagtggtctgggacagacttcactctcaccatcaaacncactgcgcctgacattttgctagtgtattactgtcagatgtatggtaggtcacgtacaccttggccgtagggaccaagggtcgaggatcgagacgaactgnggactgcaccgatctgtcttcattccc

SEQ ID NO: 324251 - DNA, 525 bp, Homo sapiens
  misc_feature: GZ8MTXP02J03WP.21.38.D05.1.454.CMB.2.raw
  modified_base (205)..(205): a, c, t, g, unknown or other
  misc_feature (205)..(205): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgccccagtgggtctggggacagacttcactctcaccatcaaacacactggcgccctgaacgtattttgcagtgtattactgtcagtatgtatggtaggtcaccgtacacctttggccagggggaccaagggtggagagtcaggacgaacgtgtacggcttgctaccgatctgtcttcactttcccg

SEQ ID NO: 324252 - DNA, 503 bp, Homo sapiens
  misc_feature: GZ8MTXP02HVF9D.21.38.D05.1.454.CMB.2.raw
  modified_base (199)..(199): a, c, t, g, unknown or other
  misc_feature (199)..(199): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
  modified_base (431)..(431): a, c, t, g, unknown or other
  misc_feature (431)..(431): n is a, c, g, or t
  modified_base (473)..(473): a, c, t, g, unknown or other
  misc_feature (473)..(473): n is a, c, g, or t
tcagtcgtcgctcgcacgaccggtgctcgatttagtatctgatagttgggtttgggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaangttactctctcctgcaaggccagtcagagtgttggcatcgacgttgcctggtaccaacaaaacctggccaggctccagtctcctcatctatggggcatcctacaggatgaccggcatcccagacaggttcagtgccagtgggtctggggacngacttcactctcaccatcaacncactgacncctgaagnttttgcagtgtatactgtcagtatgtatggtagtcaccgtanacctttggccaggggaccaagggtgagatcgagaccgaatgnggctggcaaccgatctgcttcattctcccg

SEQ ID NO: 324253 - DNA, 504 bp, Homo sapiens
  misc_feature: GZ8MTXP02I67B2.21.38.D05.1.454.CMB.2.raw
  modified_base (205)..(205): a, c, t, g, unknown or other
  misc_feature (205)..(205): n is a, c, g, or t
  modified_base (387)..(387): a, c, t, g, unknown or other
  misc_feature (387)..(387): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgcccagtgggtctgggacagacttcactctcaccatcaacacactgcncctgaagtatttgcagtgtattactgtcagatgtatggtaggtcacgtacactttggccaggggaccaagggtgagatcagacgaactgacggctgcacatctgtcttcacttcccg

SEQ ID NO: 324254 - DNA, 523 bp, Homo sapiens
  misc_feature: GZ8MTXP02FULKA.21.38.D05.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaangttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctggggacagacttcactctcaccatcaaacacactggcgcctgaacgtattttgcagttgtattactgtcagtatgtatggtagtcacgtacactttggccgtaggggaccaaggtcggagtactcgaaggacgaaacgtgtcggactgacaaccatctcgtctttcacttcttcccg

SEQ ID NO: 324255 - DNA, 533 bp, Homo sapiens
  misc_feature: GZ8MTXP02FWB90.21.38.D05.1.454.CMB.2.raw
  modified_base (205)..(205): a, c, t, g, unknown or other
  misc_feature (205)..(205): n is a, c, g, or t
  modified_base (394)..(394): a, c, t, g, unknown or other
  misc_feature (394)..(394): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcactcccagacaggttcagtgccccagtgggtctggggacagacttcactctcaccatacaaacacactggccncctagaagtattttgctagtgttattactgtcagtatgtagttgggtaggtcaaccgttactaccgtttggaccgaggggaccaagggtggagatacgagacgaacgtgacggctgaacacatctgtctcactttcccg

SEQ ID NO: 324256 - DNA, 514 bp, Homo sapiens
  misc_feature: GZ8MTXP02FZCL3.21.38.D05.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctggggacagacttcactctcaccatcaacacactgcgcctgaagattttgctagtgtattactgtcagatgtatggtagtcacgtacactttggcctaggggaccaaggtggagatcgaagacgaaactgtggctggacaaccgatctgtcttcactctttccccg

SEQ ID NO: 324257 - DNA, 536 bp, Homo sapiens
  misc_feature: GZ8MTXP02F2YZN.21.38.D05.1.454.CMB.2.raw
  modified_base (201)..(201): a, c, t, g, unknown or other
  misc_feature (201)..(201): n is a, c, g, or t
  modified_base (360)..(360): a, c, t, g, unknown or other
  misc_feature (360)..(360): n is a, c, g, or t
  modified_base (413)..(413): a, c, t, g, unknown or other
  misc_feature (413)..(413): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaacctggccaggctccccagtctcctcatctatgggcatcctacaggatgaccggcatcccagacaggttcagtgccagtggtctgggacagacttcnctctcaccatcaaacacactgcgcctagaaatattttgacagttgtaattacngtcagtatgtaagtggtaggtctaaccgtactaccgtttggacccgtaaggggaccaaagggtggaagacgtcaagtacgaaacttgtcggactgacaaccgatctagtcttcacttctaccg

SEQ ID NO: 324258 - DNA, 571 bp, Homo sapiens
  misc_feature: GZ8MTXP02HHUAZ.21.38.D05.1.454.CMB.2.raw
  modified_base (205)..(205): a, c, t, g, unknown or other
  misc_feature (205)..(205): n is a, c, g, or t
  modified_base (408)..(408): a, c, t, g, unknown or other
  misc_feature (408)..(408): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaactggccaggctccagtcctcctcatctagtgggcatcctacaggatcggaccggcactcccagaccgtaggttcagtcgcccaggtgggtctggggacagacttcactctcaccatacaaacacactgccgtctagaagtntttgctagttgtatactgtcagtatgtatggtacggtcaccgtactaccgtttgggacccgtaggggaaccgtaaggggtcggaagtacgtacgaaacggtaccgtaaacgtggtacgggtctacggccgacctagttctacgttcctttacgactttccccg

SEQ ID NO: 324259 - DNA, 512 bp, Homo sapiens
  misc_feature: GZ8MTXP02HK972.21.38.D05.1.454.CMB.2.raw
  modified_base (201)..(201): a, c, t, g, unknown or other
  misc_feature (201)..(201): n is a, c, g, or t
  modified_base (382)..(382): a, c, t, g, unknown or other
  misc_feature (382)..(382): n is a, c, g, or t
  modified_base (473)..(473): a, c, t, g, unknown or other
  misc_feature (473)..(473): n is a, c, g, or t
  modified_base (499)..(499): a, c, t, g, unknown or other
  misc_feature (499)..(499): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacagttcagtgccagtgggtctgggacagacttcactctcaccatcaacacactggcncctgaagattttgactagtgtattactgtcagattgtattggtagtcaccgtacaccgtttggcccgtaggggaccaagggtcggaagtancagacgaacgtgtcgctgcaacatcngtctcatctcccg

SEQ ID NO: 324260 - DNA, 522 bp, Homo sapiens
  misc_feature: GZ8MTXP02JFLJ4.21.38.D05.1.454.CMB.2.raw
  modified_base (201)..(201): a, c, t, g, unknown or other
  misc_feature (201)..(201): n is a, c, g, or t
  modified_base (359)..(359): a, c, t, g, unknown or other
  misc_feature (359)..(359): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggtcagtgccagtgggtctgggacagacttcnctctcaccatcaacacactgccgcctagaagtatttgactagtgtattactgtcagatgtatggtagtcaccgttacaccgtttggccagggggaccaaagggtcgaagactacgaggtacgaactggtacggctgcaaccatcgtgtcttcactcttccccg

SEQ ID NO: 324261 - DNA, 522 bp, Homo sapiens
  misc_feature: GZ8MTXP02H6IEP.21.38.D05.1.454.CMB.2.raw
  modified_base (201)..(201): a, c, t, g, unknown or other
  misc_feature (201)..(201): n is a, c, g, or t
  modified_base (358)..(358): a, c, t, g, unknown or other
  misc_feature (358)..(358): n is a, c, g, or t
  modified_base (437)..(437): a, c, t, g, unknown or other
  misc_feature (437)..(437): n is a, c, g, or t
tcagtcgtcgctcgcacgaccggtgctcgatttagtatctgatagttgggtttggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaanagttactctctcctgcaaggccagtcagagtgttggcatcgagttgcctggtaccaacaaaacctggccaggctccagtctctcatctatggggcatcctacaggatgaccggcatcccagacaggttcagtgccagtgggtctgggacagacttcnctctcaccatcaacacactcgcgcctagaacgtattttgctagtgtattactgtacagatgtatggtaggtcaccgtanaccgtttggaccaggggaccaaggtcgaagactcgaagacgaaacgtggtacgctgacctaacatctcgtcttcacttctccccg

SEQ ID NO: 324262 - DNA, 510 bp, Homo sapiens
  misc_feature: GZ8MTXP02GDGAJ.21.38.D05.1.454.CMB.2.raw
  modified_base (203)..(203): a, c, t, g, unknown or other
  misc_feature (203)..(203): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctggggacagacttcactctcaccatcaacacactgcgcctgaagtattttgcagtgtattactgtcagtatgtatggtagtcaccgtacactttggccaggggaccaagggtgagatcagacgaactgtcggactgacaacatctagtctcactcttacccg

SEQ ID NO: 324263 - DNA, 510 bp, Homo sapiens
  misc_feature: GZ8MTXP02FZX8W.21.38.D05.1.454.CMB.2.raw
  modified_base (203)..(203): a, c, t, g, unknown or other
  misc_feature (203)..(203): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctgggacagacttcactctcaccatcaacacactgacgcctgaacgtattttgcagtgtattactgtcagatgtatggtagtcacgtacacgtttggcctaggggaccaaggtcggagatcgagacgaactgtgctgcaacgtatctgtcttcatcttcccg

SEQ ID NO: 324264 - DNA, 526 bp, Homo sapiens
  misc_feature: GZ8MTXP02GX8M6.21.38.D05.1.454.CMB.2.raw
  modified_base (205)..(205): a, c, t, g, unknown or other
  misc_feature (205)..(205): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (512)..(512): a, c, t, g, unknown or other
  misc_feature (512)..(512): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatccagacagttcagtgcccagtggtctgggacagacttcgactctcaccatcaacacactggccncctgaagtntttgctagtgtattactgtacagtatgtagtggtaggtcaccgtactaccgtttggaccgtaggggaccaagggtgaacgatacgacgacgaacgtgtacgctagccactatcgtntcttcactttcccg

SEQ ID NO: 324265 - DNA, 566 bp, Homo sapiens
  misc_feature: GZ8MTXP02G1FOR.21.38.D05.1.454.CMB.2.raw
  modified_base (201)..(201): a, c, t, g, unknown or other
  misc_feature (201)..(201): n is a, c, g, or t
  modified_base (543)..(543): a, c, t, g, unknown or other
  misc_feature (543)..(543): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaacccaaacaaaacctggaccaggcctcccagtctcctcatctagtggggacactcctacgaggactacggaccggcactcccagactaggtcagtgccaggtgggtctgggacagacttcactctcacataccaacacactgccaccgtagaacgtattttgactagtagttacttacgtgtacagattgtaattgggtacgtactaaccgtactaccgtttggaccggtaacggggaccgtaagggtggaagactacgaagaccgtaacgtggcgactcgcaaccgtntacgttctcctctactccgtccg

SEQ ID NO: 324266 - DNA, 532 bp, Homo sapiens
  misc_feature: GZ8MTXP02G052N.21.38.D05.1.454.CMB.2.raw
  modified_base (204)..(204): a, c, t, g, unknown or other
  misc_feature (204)..(204): n is a, c, g, or t
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctggtaaccaacaaaacctggccaggctcccagtctcctcatctatggggcatcctacaggatgaccggcactcccagacaggttcagtgccaggtgggtctggggacagacttcactctcaccatcaaacncactgcncctagaacgtattttgactagttgtattactgtctagattgtatggtagtacaccgtactcgtttgggaccaggggaccaagggtgagacgtcgagacgaacgtgtcggactgcaacgatctcgtacttcacttcttccccg

SEQ ID NO: 324267 - DNA, 515 bp, Homo sapiens
  misc_feature: GZ8MTXP02GXAQI.21.38.D05.1.454.CMB.2.raw
  modified_base (205)..(205): a, c, t, g, unknown or other
  misc_feature (205)..(205): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtacaacaaaacctggccaggctcccagtctcctcatctatggggcatcctacaggatgaccggcatcccagacaggttcagtgccccagtgggtctggggacagacttcactctcaccatcaacacactgcgcctgaagtattttgcagttgtattactgttcagatgtatggtaggtcaccgtacacgtttggacctaggggaccaagggtgagatcagacgaactgtacggctggcaccatctgtcttcatttcccg

SEQ ID NO: 324268 - DNA, 521 bp, Homo sapiens
  misc_feature: GZ8MTXP02GZRH0.21.38.D05.1.454.CMB.2.raw
  modified_base (203)..(203): a, c, t, g, unknown or other
  misc_feature (203)..(203): n is a, c, g, or t
  modified_base (364)..(364): a, c, t, g, unknown or other
  misc_feature (364)..(364): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtcgccaggtgggtctgggacagacttcnctctcaccatcaacacactgcgcctgaacgtattttgctagtgttattactgtcagattgtatggtagtcacgtacactttggcgaggggaccaagggtgagtatcgagacgaacgtggtggctaggcaaccgtatcgtactctcattccttacccg

SEQ ID NO: 324269 - DNA, 529 bp, Homo sapiens
  misc_feature: GZ8MTXP02G2ZFI.21.38.D05.1.454.CMB.2.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
  modified_base (384)..(384): a, c, t, g, unknown or other
  misc_feature (384)..(384): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctcccggcaccctgtctctgtctccaggggaaangttactctctcctgcaaggccagtcagagtgttggcatcgacgttgcctggtaccaaacaaaacctggccaggctccagtctcctcatctatggggcatcctanaggatgaccggcatcccagacaggttcagtnccagtcgggtctgggacagcttcactctcacatcaacacactggcncctgaagtattttgctagtgtattactgtcagtatgtatggtaggtcaccgtactaccgtttggaccgtaggggaccaagggtcgaagtatacgaaggacgaactggtacggctacgcacgaatctgtcttcattccttccgacc

SEQ ID NO: 324270 - DNA, 527 bp, Homo sapiens
  misc_feature: GZ8MTXP02H6CZW.21.38.D05.1.454.CMB.2.raw
  modified_base (205)..(205): a, c, t, g, unknown or other
  misc_feature (205)..(205): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtcgcccagtgggtctggggacaggacttcactctcaccatcaaacacactgcgcctgaagattttagctagtgtattactgtacagtatgtatggtaggtcaccgtacacgtttggcctaggggaccaggtagtacgatcagacgaaactgcgtctgaactaccgaattctagtcctttcactttcccg

SEQ ID NO: 324271 - DNA, 508 bp, Homo sapiens
  misc_feature: GZ8MTXP02IBQHD.21.38.D05.1.454.CMB.2.raw
  modified_base (202)..(202): a, c, t, g, unknown or other
  misc_feature (202)..(202): n is a, c, g, or t
  modified_base (381)..(381): a, c, t, g, unknown or other
  misc_feature (381)..(381): n is a, c, g, or t
tcagtcgtcgctcgcacgaccggtgctcgatttagtatctgatagttgggtttggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacagtcagtgccagtgggtctgggacagacttcactctcaccatcaacacactgcncctgaagatttgcagtgtattactgtcagatgtatggtagtcacgtacactttggaccaggggaccaagggtgaagactcgagaacgaactgtcggctgacaaccatctagtcttcacttcctcccg

SEQ ID NO: 324272 - DNA, 509 bp, Homo sapiens
  misc_feature: GZ8MTXP02GR5PA.21.38.D05.1.454.CMB.2.raw
  modified_base (201)..(201): a, c, t, g, unknown or other
  misc_feature (201)..(201): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
  modified_base (464)..(464): a, c, t, g, unknown or other
  misc_feature (464)..(464): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctgggacagacttcactctcaccatcaacacactgcncctgaagntttgctagtgtattactgtcagatgtatggtaggtcaccgtacaccgtttggccagggggaccaaaggtggaanatacgagacgaagtgcgctgacaacgatctctctctactcctccg

SEQ ID NO: 324273 - DNA, 538 bp, Homo sapiens
  misc_feature: GZ8MTXP02IVWJT.21.38.D05.1.454.CMB.2.raw
  modified_base (203)..(203): a, c, t, g, unknown or other
  misc_feature (203)..(203): n is a, c, g, or t
  modified_base (370)..(370): a, c, t, g, unknown or other
  misc_feature (370)..(370): n is a, c, g, or t
  modified_base (394)..(394): a, c, t, g, unknown or other
  misc_feature (394)..(394): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaaccaaacaaaaacctggccaggctccagtctcctcatctatcggggcatcctacaggatgaccggcactcccagactacggttcagtgcctagtgggtctgggacagacttcnctctcaccatcaacacactcggcncctagaacgtattttgactagtgttattactgtcagtatgtagtggtagtcaccgtactcgtttggccgaggggaccaagggtgagtacgtcgaagacgtaaactggtacgctgacaaccagtctcgtcttcacttccttcccg

SEQ ID NO: 324274 - DNA, 548 bp, Homo sapiens
  misc_feature: GZ8MTXP02GRXRS.21.38.D05.1.454.CMB.2.raw
  modified_base (201)..(201): a, c, t, g, unknown or other
  misc_feature (201)..(201): n is a, c, g, or t
  modified_base (369)..(369): a, c, t, g, unknown or other
  misc_feature (369)..(369): n is a, c, g, or t
  modified_base (403)..(403): a, c, t, g, unknown or other
  misc_feature (403)..(403): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctagtggggcatcctacaggatcgaccggcactcccagactaggttcagtcgccgaggtgggtctgggacaggtacttcnctctcaccatccaacacacgtgcgcctagaagtntttgactagtgtaattctgtcagtattgtagttggtacggttcaaccgtactaccgtttgggaccgtaagggggaccaaggggtggaagtactcgaagacgaacgtggcgctgaccaacgtatctacgtctactacttcctcccg

SEQ ID NO: 324275 - DNA, 604 bp, Homo sapiens
  misc_feature: GZ8MTXP02JLN65.21.38.D05.1.454.CMB.2.raw
  modified_base (206)..(206): a, c, t, g, unknown or other
  misc_feature (206)..(206): n is a, c, g, or t
  modified_base (411)..(411): a, c, t, g, unknown or other
  misc_feature (411)..(411): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaacctggccaggcctccagtcctcctcatctagtgggcactcctacgaggatcggaccggcactcccgagacgtaggttcagtcgccccgaggtggtcgtggggacacgtacttcacctctccaccatacaacacacgtcggcnccgtagaagttagtttgctagttgttacttactgtacagtagtagtagttagggtacggtacctaccgtacctaccggtttcggaccggaggggtaaccgtaaggggtgggaacgtactacgaacggtaacgtaacgtcggtacggtcgtacggaaccaccgtacttcgtacgttccttacgtactttccccg

SEQ ID NO: 324276 - DNA, 568 bp, Homo sapiens
  misc_feature: GZ8MTXP02JN11L.21.38.D05.1.454.CMB.2.raw
  modified_base (201)..(201): a, c, t, g, unknown or other
  misc_feature (201)..(201): n is a, c, g, or t
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatggaccggcatcccagacaggttcagtgccagtgggtctgggacaggacttcactctcaccatcaacacactgcncctagaagtnttttgactagtgttaattactgtcagtattagtagttggtaggtcaaccgttactaccgtttacgggaccgaggggacccgtaagggtggaagacgttacgaaggtaaccgaacgttaggtcggtacctaggacctaaccagttccttacgtcctttacacgtttccttccccg

SEQ ID NO: 324277 - DNA, 587 bp, Homo sapiens
  misc_feature: GZ8MTXP02HISW5.21.38.D05.1.454.CMB.2.raw
  modified_base (202)..(202): a, c, t, g, unknown or other
  misc_feature (202)..(202): n is a, c, g, or t
  modified_base (376)..(376): a, c, t, g, unknown or other
  misc_feature (376)..(376): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtactccaggggaaanagttactctctcctgcaaggccagtcagagtgttggcatcgacgttgcctaggtaaccaaacaaaacctggaccaggcctcccagtcctcctcatctagtggggcactcctacgaggactggaccggcactcccagacaggttcagtcgccaggtgggtctgggacagacttcnctctcaccatacaacacacgtgcgcctagtaagtattttgactagttagtattacgtgtactagtattagtagttgggtacgtcgtaaccgttacgtaccgtttgggaccgtaacgggggaacctaaggggtggaacgtaactacgaaggtaaccgtaagtggtcggactcggaccaacgtacttcgtacgtccttacactttccctcccg

SEQ ID NO: 324278 - DNA, 518 bp, Homo sapiens
  misc_feature: GZ8MTXP02GH0L0.21.38.D05.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (394)..(394): a, c, t, g, unknown or other
  misc_feature (394)..(394): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttacnctctcctgcaaggccagtcagagtgttggcatcgacgttgcctggtaccaacaaaacctggccaggctcccagtctcctcatctatggggcatcctacaggatgaccggcatcccagacaggttcagtgccccagtgggtctggggacagacttcgactctcaccatcaaacacaactggcncctgaacgtattttgctagtcgtattactgtacagtatgtatggtagtcaccgtactacgtttggccaggggaccaaggtggagatcagacgactggtacggctgcaccatctgtctcacttcc

SEQ ID NO: 324279 - DNA, 620 bp, Homo sapiens
  misc_feature: GZ8MTXP02H7QSM.21.38.D05.1.454.CMB.2.raw
  modified_base (200)..(200): a, c, t, g, unknown or other
  misc_feature (200)..(200): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (382)..(382): a, c, t, g, unknown or other
  misc_feature (382)..(382): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaangttactctctcctgcaaggccagtcagagtgttgcatcgagttgcctggaaccaacaaaactggccaggctccagtctccncatctatggggcatcctanaggatgaccggcactcccagacaggttcagtgccaggtggtctggggacagacttcgactctacaccatcaacacactcgcncctagaagtatttgactagttgtacttacgtgtactagtagttagttagttagggtacggtactaacccgttacgtacccgtttcgggacccgtaagggggtaaccctaaagggggtcggaacgtaacttcgaaacggtaacggtaaaaccgtgggttaacggggccgttacgggacctaaacccgtacggttaaccttcgggtttacctttcctaacgtttaccccggtttcccccg

SEQ ID NO: 324280 - DNA, 542 bp, Homo sapiens
  misc_feature: GZ8MTXP02HFN7E.21.38.D05.1.454.CMB.2.raw
  modified_base (202)..(202): a, c, t, g, unknown or other
  misc_feature (202)..(202): n is a, c, g, or t
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
  modified_base (492)..(492): a, c, t, g, unknown or other
  misc_feature (492)..(492): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctaggtaaccaaacaaaacctggaccaggctcccagtctcctcatctatggggcatcctacgaggatgaccggcactcccagacaggttcaggtcgccgaggtgggtcgtgggactagtacttcncctctacaccatacaacacactcggcncctagaagtatttgctagtntattactgtactagattgtagtggtagtctaccgtacgtaccgttggaccggagggactaggtagacgtanacgagacgtacgtgacgctgactaacgactctcgttctcacttcctcccg

SEQ ID NO: 324281 - DNA, 542 bp, Homo sapiens
  misc_feature: GZ8MTXP02HA6CA.21.38.D05.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagtatctgatagttgggtttggggaagagctgctcagttaggacccagaggaaaccatggaaaccccagcgcagcttctcttcctcctgctactctggctcccaggtgtcaccggagaagttgtcttgacgcagtctccaggcaccctgtctctgtctccaggggaanagttactctctcctgcaaggccagtcagagtgttggcatcgacgttgcctggtaccaacaaaaacctggccaggctcccagtctcctcatctatggggcatcctacaggatgaccggcatccccagacaggttcagtgccagtgggtctgggacaggacttcactctcaccatcaacacactgcgcctgaagtattttgcagtgtattactgtcagattgtatggtagtcaacgtacaccgtttggccgtaggggaccaagggtggagagtacgagacgtaaacgtggtcggctggaccaaccgtaatcgttcggtactttccacgtttccgtttcccccg

SEQ ID NO: 324282 - DNA, 537 bp, Homo sapiens
  misc_feature: GZ8MTXP02GXG2N.21.38.D05.1.454.CMB.2.raw
  modified_base (206)..(206): a, c, t, g, unknown or other
  misc_feature (206)..(206): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (519)..(519): a, c, t, g, unknown or other
  misc_feature (519)..(519): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgagttgcctggtaccaacaaaactggccaggctccagtctcctcatctatggggcatcctacaggatgaccggcactcccagacaggttcagtgccccagtggtctgggacagacttcactctcaccatcaacacactgcncctgaacgtnttttgctagtcgtattactgttcagtatgtatggtagtcacgtacaccgtttgccgaggggtaccaaagggtggaagtagtacgaacgacggaaactggtacggcgtacgcgacctagttccngttcttctactttccccg

SEQ ID NO: 324283 - DNA, 521 bp, Homo sapiens
  misc_feature: GZ8MTXP02FXPTN.21.38.D05.1.454.CMB.2.raw
  modified_base (203)..(203): a, c, t, g, unknown or other
  misc_feature (203)..(203): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgccagtggtctgggacagacttcactctcaccatcaacacactgcgccctgaaacgtattttgactagttgtaattactgtcagatgtatggtagtcacgtacacgtttggccaggggaccaaggtcgagatcgagacgaactggtcggactgcaaccgtatctgtccttacacgtcttacccg

SEQ ID NO: 324284 - DNA, 550 bp, Homo sapiens
  misc_feature: GZ8MTXP02IYNIZ.21.38.D05.1.454.CMB.2.raw
  modified_base (142)..(142): a, c, t, g, unknown or other
  misc_feature (142)..(142): n is a, c, g, or t
  modified_base (203)..(203): a, c, t, g, unknown or other
  misc_feature (203)..(203): n is a, c, g, or t
  modified_base (392)..(392): a, c, t, g, unknown or other
  misc_feature (392)..(392): n is a, c, g, or t
  modified_base (425)..(425): a, c, t, g, unknown or other
  misc_feature (425)..(425): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtntcaccggagaagttgtcttgacgcagtctccaggcaccctgtctctgtctccaggggaaangttactctctcctgcaaggccagtcagagtgttggcatcgacgttgcctggtaaccaacaaaacctggccaggctcccagtctcctcatcagtgggcatcctacaggatcggaccgcactcccagacaggttcagtgccaggtcggtctgggacaggtacttcactctcaccatccaacacacgtgccnccttagaatatttgctagtgtattactgtcaangtgtatggtacgtactaccgtaactcgttacgggccgtaaggggtaccaagggtcgaggtaactcggaagtaccgaagttggcggtactggaccaacctgtactcgtcttactacgtcttccccg

SEQ ID NO: 324285 - DNA, 579 bp, Homo sapiens
  misc_feature: GZ8MTXP02JODOJ.21.38.D05.1.454.CMB.2.raw
  modified_base (202)..(202): a, c, t, g, unknown or other
  misc_feature (202)..(202): n is a, c, g, or t
  modified_base (389)..(389): a, c, t, g, unknown or other
  misc_feature (389)..(389): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgagttgcctggtaccaacaaaacctggccaggctcccagtctcctcatctataggcatcctacaggatggaccggcactcccagacaggttcagtgccaggtgggtctgggacagacttcgctctacacctatacaacacactggccncctagaagtattttgacgtagttggtattacgtgtacagtattggtaagtggggttacgtacgtaacccgttactaccgtttcgggccgtaagggggtaaccaagggtacggagtaacgtccgaaggtacgaaacgttgggacgtccgtgacctaacgtattccgtcgttactacacgtttcctaccccg

SEQ ID NO: 324286 - DNA, 741 bp, Homo sapiens
  misc_feature: GZ8MTXP02F3L76.21.38.D05.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaangttactctctctgacgacgcagtcagtagttggtgactagtcgtagtcgcgtacgtaacaaacaaacgtcgacgagcctaccagtcctcctcacttctaggtcgggactactccgtagaggatacggaccggactacctacccgagacgttaggtacagtcgaccgtagggttcggtacgtagggaactacgttaccttacaccttccacctaaacctactaaccgaaactacgtacggttcgggaccctaccgttaaggaaaacgttttgtttaccgaagttaggtttacgttaaactttcgtacgtataaggtagttaggttaggttacggggttacctaaccgtaaccgttaacccgttcgggtttaccgggaaccgggttaaacgggggaccgtaaagggggtaggaacgtttaacgaaccggtaaacgggtaaacgtaaaccggttgggggtaccggttaacccgtaccggtaaccctaacgttacgtttaccggttacctttaccgttaccgttacccgtttccccgttaccccg

SEQ ID NO: 324287 - DNA, 538 bp, Homo sapiens
  misc_feature: GZ8MTXP02I5YNC.21.38.D05.1.454.CMB.2.raw
  modified_base (206)..(206): a, c, t, g, unknown or other
  misc_feature (206)..(206): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggaccaggctccagtctcctcatctatggggcacgtcctacgaggatggaccggcactcccagacagttcagtcgcccagtggtctgggacagacttcactctacaccatacaaacacacgtgaccgcctagaagtattttgctagttgttattacgtgtacagtatgttagtgggtaggtccacgtactacgtttggaccgaggggtaccagggtgaacgatcgagacgaacgtgacggctgctacagtctgtacttcgacttccc

SEQ ID NO: 324288 - DNA, 581 bp, Homo sapiens
  misc_feature: GZ8MTXP02JSPG0.21.38.D05.1.454.CMB.2.raw
  modified_base (201)..(201): a, c, t, g, unknown or other
  misc_feature (201)..(201): n is a, c, g, or t
  modified_base (363)..(363): a, c, t, g, unknown or other
  misc_feature (363)..(363): n is a, c, g, or t
  modified_base (386)..(386): a, c, t, g, unknown or other
  misc_feature (386)..(386): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaacctggccaggctcccagtctcctcatctatggggcatcctacaggataggaccggcactcccagacaggttcagtgcagtgggtctgggacagacttcnctctcaccatcaacacactggcncctgagtatttgactagtgtattactgtcagattgtagtggtagtccgaccgttactaccgtttacgggaccgtagggggaaccctaaggggtcggaacggtacgttacgaggtaaaccggacgttggtacggtcgttacggacctaaccgtacgttcgtacggttccgtttaccgtactttcccgtttaccccg

SEQ ID NO: 324289 - DNA, 525 bp, Homo sapiens
  misc_feature: GZ8MTXP02JB8WS.21.38.D05.1.454.CMB.2.raw
  modified_base (200)..(200): a, c, t, g, unknown or other
  misc_feature (200)..(200): n is a, c, g, or t
  modified_base (360)..(360): a, c, t, g, unknown or other
  misc_feature (360)..(360): n is a, c, g, or t
  modified_base (418)..(418): a, c, t, g, unknown or other
  misc_feature (418)..(418): n is a, c, g, or t
tcagtcgtcgctcgcacgaccggtgctcgatttagtatctgatagttgggtttgggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaaacctggaccaggctcccagtctcctcatctatggggcatcctacaggatgaccggcatcccagacaggttcagtgccagtggtctgggacagacttcnctctcaccatcaacacactgcacctgaagtattttgactagtgttattactgtacagnttgtatgggtagttcacgtactaccgttggccgaggggacctaagggtcgagacgtcagtacgaacgtgtcggctgacaacagtctgtactttcgacttcttccccg

SEQ ID NO: 324290 - DNA, 538 bp, Homo sapiens
  misc_feature: GZ8MTXP02F473I.21.38.D05.1.454.CMB.2.raw
  modified_base (201)..(201): a, c, t, g, unknown or other
  misc_feature (201)..(201): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaaacctggaccaggctcccagtctcctcatctagtggggcatcctacaggatgaccggcactcccgagacaggttcagtgccaggtgggtctgggacagacttcactctcaccactcaaacacactgcnccctgaaacgtntttgactactagttatactgtacagtatgtagtgtagtcacgtacacgtttcgcgtaagggacaagggtcgaagactacaggacgtaaacgtgtcggtctagcaaccgtatcgtcgtcttacgactccttacccg

SEQ ID NO: 324291 - DNA, 528 bp, Homo sapiens
  misc_feature: GZ8MTXP02HXNZH.21.38.D05.1.454.CMB.2.raw
  modified_base (201)..(201): a, c, t, g, unknown or other
  misc_feature (201)..(201): n is a, c, g, or t
  modified_base (363)..(363): a, c, t, g, unknown or other
  misc_feature (363)..(363): n is a, c, g, or t
  modified_base (386)..(386): a, c, t, g, unknown or other
  misc_feature (386)..(386): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaaacctggccaggctcccagtctcctcatctatggggcactcctacaggatgaccggcactcccagactaggtcagtgccagtggtcgtggacagtacttcnctctcacatacaacacactcgcncctagaagtatttgactagtgttatactgtcagtatgtagttggtagtcaccgtactacgtttcggaccgagggaccgaggtggagactacgaggacgaagtcggacgtctgcaacgtctctcgtcttacacttcctacccg

SEQ ID NO: 324292 - DNA, 594 bp, Homo sapiens
  misc_feature: GZ8MTXP02IVVWH.21.38.D05.1.454.CMB.2.raw
  modified_base (205)..(205): a, c, t, g, unknown or other
  misc_feature (205)..(205): n is a, c, g, or t
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
tcagtcgtcgctcgcacgaccggtgctcgatttagtatctgatagttgggtttgggggaagagctgctcagttaggacccagagggaaccatggaaaaccccagcgcagcttctcttcctcctgctactctggctcccaggtgtcaccggagaagttgtcttgacgcagtctccaggcaccctgtctctgtctccaggggaaagngttactctctcctgcaaggccagtcagagtgttggcatcgacgttgcctggtaccaacaaaacctggccaggctcccagtctcctcatctatggggcatcctacaggatcggaccggcactcccagacaggttcagtgccagtggctgggacagacttcnctctcacatcaacacactggcncctagaaagtattttgactagtagttattactgtcagtattgtagtggttacgtctaccgtactaccgtttcggaccgtaacgggggtaccaagggtcggaacggtactaccggaaaggtaccggtaaacgttgggtacgggaccttacggactaacccgtagttacccgttacggttacctttacctacgtttaccctttccccgg

SEQ ID NO: 324293 - DNA, 565 bp, Homo sapiens
  misc_feature: GZ8MTXP02G7A9S.21.38.D05.1.454.CMB.2.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttgcatcgacgttgcctggtacaacaaaactgcagctccagtctcctcatctatgggcatcctacagatnacggcatcccagacaggttcagtgcagtgggtctgggacagacttcactctnaccatacaaacacactggccncctagaagtatttgactagtagttaattactgtactagtagtagtagttaggtaggtacgtaccgtaaccgtaccgttacggtacggacgggaacggaacggtaggtaaggtaacgtacgaacgaacgaaacgtacggtacggtacgtacgacgaaccgtactacttacgttactactactacgttcccg

SEQ ID NO: 324294 - DNA, 562 bp, Homo sapiens
  misc_feature: GZ8MTXP02GT4JC.21.38.D05.1.454.CMB.2.raw
  modified_base (201)..(201): a, c, t, g, unknown or other
  misc_feature (201)..(201): n is a, c, g, or t
  modified_base (397)..(397): a, c, t, g, unknown or other
  misc_feature (397)..(397): n is a, c, g, or t
  modified_base (423)..(423): a, c, t, g, unknown or other
  misc_feature (423)..(423): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctaggtaaccaaacaaaacctggccaggctccagtctcctcatctagtgggcatcctacaggatgaccggcattccagacaggttcagtgccaggtgggtctgggacagacttcactctacaccataccaacacactgcgcctgaagtntttgactagtgttatactgtacagtnttgtagttgggtagtcaaccgtactaccgttggaccgaaggggtaccaagggtcgaagtacgtcgaagaaccggtactagggtcgtctaggacctaaccgtattcgttacgttccttacgtactttcccgtttaccccg

SEQ ID NO: 324295 - DNA, 559 bp, Homo sapiens
  misc_feature: GZ8MTXP02JVP5V.21.38.D05.1.454.CMB.2.raw
  modified_base (201)..(201): a, c, t, g, unknown or other
  misc_feature (201)..(201): n is a, c, g, or t
  modified_base (368)..(368): a, c, t, g, unknown or other
  misc_feature (368)..(368): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaacctggccaggctcccagtctcctcatctatggggcatcctacaggatgaccggcactcccagacaggttcagtgccaggtcgggtctgggacagacttcactcncaccataccaacacacgtcggccgacctagaagtattttgctagttgttattactgtactagattgtagttggtagtcctaccgtactaccgtttggaccgaggggaccaagggtcggaagtactcgaggacgtaacgtggtacgcgtagccgtaacctattcgtcgttcctacctacttcccgttccccg

SEQ ID NO: 324296 - DNA, 523 bp, Homo sapiens
  misc_feature: GZ8MTXP02HE216.21.38.D05.1.454.CMB.2.raw
  modified_base (205)..(205): a, c, t, g, unknown or other
  misc_feature (205)..(205): n is a, c, g, or t
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctcgaggggaaanagttactctctcctgcaaggccagtcagagtgttggcatcgacgttgcctggtaccaacaaaacctggccaggctcccagtcctcctcatctatgggcatcctacaggatgaccggcactcccagacaggttcagtgccccagtggtctgggacagacttcactctcaccatcaacacacgtgccgcctgaatattttgactagtagtattactgtacagtatgttaatgggttaggtacacgtacacgtttgaccgaggggacaggngagagtanaagacgacgtgaggctgaacaccagtctgtactctattcccg

SEQ ID NO: 324297 - DNA, 586 bp, Homo sapiens
  misc_feature: GZ8MTXP02H9ZCB.21.38.D05.1.454.CMB.2.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
  modified_base (440)..(440): a, c, t, g, unknown or other
  misc_feature (440)..(440): n is a, c, g, or t
  modified_base (549)..(549): a, c, t, g, unknown or other
  misc_feature (549)..(549): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctcgaggggaaangttactctctcctgcaaggccagtcagagtgttggcatcgagttgcctggtaaccaaacaaaacctggccaaggcctcccagtcctcctcatctaagtggggctatcctacaggatgaccggcatcccagacaggttcagtgccaggtgggtctagggacaggacttcactctacaccataccaaacactacgngccgacctagaaagtnttttgactagtagttaattactgttanaagtattggtaattgggtaagtaccgtaaccgtactaccgtttagggaccgtaggggaaccgtaagggtaggaacggtataacgaggaaaccgtaaagtggtcggaccncgacaacgtactcttttcgactttactacttcctccg

SEQ ID NO: 324298 - DNA, 625 bp, Homo sapiens
  misc_feature: GZ8MTXP02I6EUH.21.38.D05.1.454.CMB.2.raw
  modified_base (206)..(206): a, c, t, g, unknown or other
  misc_feature (206)..(206): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgagttgcctggtacaacaaaactggccaggctccagtctcctcatctagtgggcatcctacaggatgaccggcactccagactaggttcagtcgccccgtaggtcgggtctaggggacaggtactcactctaccaccatacaaactacactcggccgtacctaggaagtattttgctagttgtaattacgtgtactaagtagtagttagtacgggtacggttaccaaccgttacgtaccgtttagggacccggtaagggggtaaccgtaaaggggttaggaacgtaacgttacggaaacggtaaacgtaaaccgtgggtaacggtccgttaggaaccctaacgtacttacgttacgtttccttacgtaacctttcccccg

SEQ ID NO: 324299 - DNA, 540 bp, Homo sapiens
  misc_feature: GZ8MTXP02GA4QT.21.38.D05.1.454.CMB.2.raw
  modified_base (207)..(207): a, c, t, g, unknown or other
  misc_feature (207)..(207): n is a, c, g, or t
  modified_base (415)..(415): a, c, t, g, unknown or other
  misc_feature (415)..(415): n is a, c, g, or t
  modified_base (477)..(477): a, c, t, g, unknown or other
  misc_feature (477)..(477): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctaggtaaccaaacaaaacctggaccaggcctcccagtcctcctcatctagtggggcatcctacgaggatcgaccggcactccagacagtcagtgcccagtggtctgggacagacttcactctcaccatacaaacacactggcactgaatatttgctagtntatactgtacagatgtagtggtagtctaccgtactacgttggacgtaggggaaccgtagggngaacgtatacgacgaacgtaagtcgtggctggaacctacgtactctgtctacgtactttcccg

SEQ ID NO: 324300 - DNA, 511 bp, Homo sapiens
  misc_feature: GZ8MTXP02IKS7J.21.38.D05.1.454.CMB.2.raw
  modified_base (206)..(206): a, c, t, g, unknown or other
  misc_feature (206)..(206): n is a, c, g, or t
  modified_base (384)..(384): a, c, t, g, unknown or other
  misc_feature (384)..(384): n is a, c, g, or t
  modified_base (405)..(405): a, c, t, g, unknown or other
  misc_feature (405)..(405): n is a, c, g, or t
  modified_base (490)..(490): a, c, t, g, unknown or other
  misc_feature (490)..(490): n is a, c, g, or t
  modified_base (497)..(497): a, c, t, g, unknown or other
  misc_feature (497)..(497): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttgcatcgacgttgcctgtaccaacaaaactggcaggctccagtctcctcatctatgggcatcctacaggatgaccggcactcccagacaggttcagtgcccagtggtctgggacagcttcactctcaccatcaaacacactggccnctagaagtattttgcgtagtnttattactgtacagtatgtatggtaggtcacgtactacgtttggaccaggggtaccagggtcgagatcgagtaacgactcgcgcngaacacntctgtctcactccg

SEQ ID NO: 324301 - DNA, 577 bp, Homo sapiens
  misc_feature: GZ8MTXP02JHQFO.21.38.D05.1.454.CMB.2.raw
  modified_base (205)..(205): a, c, t, g, unknown or other
  misc_feature (205)..(205): n is a, c, g, or t
  modified_base (388)..(388): a, c, t, g, unknown or other
  misc_feature (388)..(388): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaacctggccaggctcccagtctcctcatctatggggcatcctacaggatgaccggcatcccagacaggttcagtgcccagtgggtctgggacagactcactctcaccatcaacacactggcnctagaatatttgctagttcgtattactgtacagtattgtaagttgggtacgttcaaccgttacgtaccgtttcgggaccgtaagggggaccaaaggggtcggtaagtacgtagaaacggacgtaaacggttggtacgggtcttacggaaccaacccgtattccgttacggtactttcaacgtttccccg

SEQ ID NO: 324302 - DNA, 518 bp, Homo sapiens
  misc_feature: GZ8MTXP02GNJKD.21.38.D05.1.454.CMB.2.raw
  modified_base (206)..(206): a, c, t, g, unknown or other
  misc_feature (206)..(206): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaaacaaaacctggccaggctcccagtctcctcatctatggggcatcctacaggatgaccggcactcccagaccaggttcagtgccccgagtggtctgggacagacttcactctacacatcaacacactggcnctagaagtntttgctagttgtattactgtacagtatgtagtggtagtcaccgtactcgttggacaggggacctaaggtgagtagtcacgacgaactggtacgctgctactatctgtctcattccc

SEQ ID NO: 324303 - DNA, 602 bp, Homo sapiens
  misc_feature: GZ8MTXP02I6LK1.21.38.D05.1.454.CMB.2.raw
  modified_base (203)..(203): a, c, t, g, unknown or other
  misc_feature (203)..(203): n is a, c, g, or t
  modified_base (395)..(395): a, c, t, g, unknown or other
  misc_feature (395)..(395): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgagggaaangttactctctcctgcaaggccagtcagagtgttggcatcgacgttgcctggtaaccaacaaaacctggaccaggctcccagtctcctcatctagtgggcatcctacaggatgaccgcatcccagacaggtcagtgccaggtggtctagggacagacttcactctcaccatcaacacactgcacctagaagtnttttgactagttagtatttacgtgtacagtattagtagttgggtacgtcctaaccgtacgtaccgtttacgggacccgtaaagggggtacccaaggggttacggaacggtaacttacggaaacggtaacggtaaacgttggggttacgcgttacgaccgaacccgtagttaccttacggttcttacctaactttcccgttacccccg

SEQ ID NO: 324304 - DNA, 505 bp, Homo sapiens
  misc_feature: GZ8MTXP02FZB8V.21.38.D05.1.454.CMB.2.raw
  modified_base (203)..(203): a, c, t, g, unknown or other
  misc_feature (203)..(203): n is a, c, g, or t
  modified_base (387)..(387): a, c, t, g, unknown or other
  misc_feature (387)..(387): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaaacctggccaggctcccagtctcctcatctatggggcatcctacaggatgaccggcatcccagacaggttcagtaccagtcgggtctgggacagacttcactctcaccatcaacacactggcncctgaagtattttgctagtgttatactgtcagatgtatggtagtcacgtacacttggcaggggacaggtgagatcgagacgaactgtgctgcacaatctgtcttcacgtcctccgtcc

SEQ ID NO: 324305 - DNA, 541 bp, Homo sapiens
  misc_feature: GZ8MTXP02FW8SB.21.38.D05.1.454.CMB.2.raw
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgaagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtcgggtctggggacagacttcactctcaccatcaacacactggccgcctgaagtattttgctagtgttattaactgtacagtattgtagttgggtaggtccaaccggttactaccgtttgggacccgagggggaccaagggtgggaagatacgagacgaactggacgctgcaccaatctgtcttcactcctccgtcc

SEQ ID NO: 324306 - DNA, 540 bp, Homo sapiens
  misc_feature: GZ8MTXP02GELQ7.21.38.D05.1.454.CMB.2.raw
  modified_base (201)..(201): a, c, t, g, unknown or other
  misc_feature (201)..(201): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctccagtctcctcatctagtgggcatcctacaggatgaccggcatcccagacaggttcagtgccagtcgggtctggggacagtaccttcactctccacatacaacacactgcncctagaatntttgctagttgtaattactgtacagtattgtagtggtagtccacgtactacgttggcgtaaggggacctaagggtgagactcgagacgtaacgtgtacggctggaccaactacgtcgtacgttacttactacgttccgttccccg

SEQ ID NO: 324307 - DNA, 560 bp, Homo sapiens
  misc_feature: GZ8MTXP02HT9SF.21.38.D05.1.454.CMB.2.raw
  modified_base (202)..(202): a, c, t, g, unknown or other
  misc_feature (202)..(202): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcacctgtctctgtctccaggggaaanagttactctctcctgcaaggccagtcagagtgttggcatcgagttgcctggtaccaacaaaactggccaggctcccagtctcctcatctatggggcatcctacaggatcgaccggcactccagacagtcagtgccagtggtctgggacagacttcnctcncaccatacaacacactgcacctgaacgtatttgcagttgtatacgttgtacagtatgtatgggtagtcaccgtacgtacgtttcggacgtaacgggggacctaagggtacggaacgtagacgtaacggaactaacgtggtacgtcgtacggacctaaccgtaagtccgtacgttaccttctaacttcccttaccccgg

SEQ ID NO: 324308 - DNA, 517 bp, Homo sapiens
  misc_feature: GZ8MTXP02JBGAM.21.38.D05.1.454.CMB.2.raw
  modified_base (201)..(201): a, c, t, g, unknown or other
  misc_feature (201)..(201): n is a, c, g, or t
  modified_base (357)..(357): a, c, t, g, unknown or other
  misc_feature (357)..(357): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaacctggccaggctccagtctcctcatctatgggcatcctacaggatgaccggcatcccagacaggttcagtgccagtggtctggacagacttcnctctcacatcaacacactcgcgcctagaagtattttgcagttcgtatctgtcagtatgtatggtagtctacgtactacgttggacgagggaccagggtcgagacgtcaggacgaacgtggtcgactgctaaccgattctagtcctacacttccttacccg

SEQ ID NO: 324309 - DNA, 535 bp, Homo sapiens
  misc_feature: GZ8MTXP02GJZIF.21.38.D05.1.454.CMB.2.raw
  modified_base (201)..(201): a, c, t, g, unknown or other
  misc_feature (201)..(201): n is a, c, g, or t
  modified_base (387)..(387): a, c, t, g, unknown or other
  misc_feature (387)..(387): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaaacctggccaggctccagtctctcatctatggggcatcctacaggatgaccggcactcccagacaggttcagtgccagtggggtctggggacaggacttcactctcaccatcaacacactggcncctgaagtattttgcagtgtattactgtcagtatgtacttggtaggtcaccgtaactaccgtttggacgtaaggggacctaaggggtcgagacgtacgagacgtaactgtcggctgacaacgatctacgtcttcgacttccgttcccg

SEQ ID NO: 324310 - DNA, 584 bp, Homo sapiens
  misc_feature: GZ8MTXP02IAI0Z.21.38.D05.1.454.CMB.2.raw
  modified_base (204)..(204): a, c, t, g, unknown or other
  misc_feature (204)..(204): n is a, c, g, or t
  modified_base (441)..(441): a, c, t, g, unknown or other
  misc_feature (441)..(441): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangtttactctctcctgcaaggccagtcagagtgttggcatcgagttgcctggtaaccaacaaaaacctggccaggcctcccagtcctcctcatctatggggcatcctacaggatggaccggcactcccgagacaggtcagtcgccaggtgggtcgtggggacagtacttcactccgtacacctactacaacacacgtcgcgacctagaagtatttgactagtgttatactgtacagtntagtagttggtacgtacacgtactaccgtttcggacgtacggggtaaccagggtaggaagtacgtacgtaggaacgtaaacgtggtacgggcttaggaccaaccgtataccgttcggtacctttacacgtttcccgttccccg

SEQ ID NO: 324311 - DNA, 628 bp, Homo sapiens
  misc_feature: GZ8MTXP02GLEO1.21.38.D05.1.454.CMB.2.raw
  modified_base (203)..(203): a, c, t, g, unknown or other
  misc_feature (203)..(203): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaangttactctctcctgcaaggccagtcagagtgttggcatcgacgttgcctggtaaccaaacaaaaacctggccaggctcccagtcctcctcatctagtggggcatcctacaggatggaccggcactcccagacaggttcagtgccaggtggtctgggacagtacttcnctcacaccatcaacacactgcncctagaatattttgactagttagttaactttacgtagtctaaaggtattaggttagttgggtacgttaccgtaacccgttacctaccgttttacgggaccgtaaacgggggacccgtaaaggggtcgggaaacgtacgttaacgaacgggtaaacgtaaacgttggttacggacgtcggtaaccgaaccttacgttaccgttacgtacctttacaaccgtttccctttacccccgg

SEQ ID NO: 324312 - DNA, 576 bp, Homo sapiens
  misc_feature: GZ8MTXP02IRRI1.21.38.D05.1.454.CMB.2.raw
  modified_base (203)..(203): a, c, t, g, unknown or other
  misc_feature (203)..(203): n is a, c, g, or t
  modified_base (371)..(371): a, c, t, g, unknown or other
  misc_feature (371)..(371): n is a, c, g, or t
  modified_base (397)..(397): a, c, t, g, unknown or other
  misc_feature (397)..(397): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaanagttactctctcctgcaaggccagtcagagtgttggcatcgacgttgcctggtaaccaaacaaaaacctggccaggctcccagtctcctcatctagtcggggcatcctacgaggatcgaccggcactcccagacaggtcagtgcaggtgggtctgggacagaccttcnctctacaccatccaacacactgggcncctagaatattttcgactacgttagttattaacgtgtacagtattgtagttgggtagtcgtaacccgtacgtaccgtttggccgtaacgggggaccaaagggtggaagtactcgaagacgaaacgtggtcgacgtcgaccgaactagttctagttccttactacgtttcccttaccccg

SEQ ID NO: 324313 - DNA, 633 bp, Homo sapiens
  misc_feature: GZ8MTXP02GY2YC.21.38.D05.1.454.CMB.2.raw
  modified_base (202)..(202): a, c, t, g, unknown or other
  misc_feature (202)..(202): n is a, c, g, or t
  modified_base (286)..(286): a, c, t, g, unknown or other
  misc_feature (286)..(286): n is a, c, g, or t
  modified_base (589)..(589): a, c, t, g, unknown or other
  misc_feature (589)..(589): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgagttgcctggtaccaaacaaaacctggccaggctccagtctccnatctagtgggacatcctacaggatcgaccggcactcccagtacgaggttcagtcgccgaggtcgggtcgtagggacagtaccttcgactctacacctactaccaaacacacgtcgggacctaccgtagtaaagttacgtttgacgtaacgttgttaactttaccgtagtactaaggtattaggttacgttaggggttacggtaccctacccggttaaccttaccggtttacggaccggtaacgggggtaacctaaggggtaggaacgttacgacgaacggtacggtaacgtgggtcggtaccncgactaacgtacgtcgttacgtaccttacgtaccgttcctcccg

SEQ ID NO: 324314 - DNA, 579 bp, Homo sapiens
  misc_feature: GZ8MTXP02F3JEP.21.38.D05.1.454.CMB.2.raw
  modified_base (206)..(206): a, c, t, g, unknown or other
  misc_feature (206)..(206): n is a, c, g, or t
  modified_base (305)..(305): a, c, t, g, unknown or other
  misc_feature (305)..(305): n is a, c, g, or t
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttgcatcgagttgcctgtacaacaaaactgccaggctccagtctctcatctatgggcatcctacaggntgaccgcatccagacaggtcagtgccccagtcgggtctgggacagacttcactctcaccatacaacacactggaccnccagaagtnttttaggctagttagtattacgtgtactagatagttagtggtacgggttccaaccgttactaccgtttcggaccgtaggggaaccgtaagggttacggaagtacgttaccggaaaggaacgtaaaccgttaggttacggcttacggaactaccgtaattccgtacggttcttacgtaacgtttccccg

SEQ ID NO: 324315 - DNA, 543 bp, Homo sapiens
  misc_feature: GZ8MTXP02JGZAZ.21.38.D05.1.454.CMB.2.raw
  modified_base (205)..(205): a, c, t, g, unknown or other
  misc_feature (205)..(205): n is a, c, g, or t
  modified_base (330)..(330): a, c, t, g, unknown or other
  misc_feature (330)..(330): n is a, c, g, or t
  modified_base (383)..(383): a, c, t, g, unknown or other
  misc_feature (383)..(383): n is a, c, g, or t
  modified_base (446)..(446): a, c, t, g, unknown or other
  misc_feature (446)..(446): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttgcatcgacgttgcctggtaccaacaaaacctggccaggctcccagtctcctcatctatggggcatcctacaggatgaccggcatcccagacnggttcagtgccccagtggggtctggggacagtctcgactctcaccatcaaacncactgcgctgacgtatttgctagtcgtattacgtgtacagatgtaagtgggtagtcaccgtanaccgtttggaccgaagggggtaccaagggtcggagacttacgaacgacgtaaactgtcggcctgaaccactacgtcgtcgtctttacactttccccg

SEQ ID NO: 324316 - DNA, 510 bp, Homo sapiens
  misc_feature: GZ8MTXP02JFLVL.21.38.D05.1.454.CMB.2.raw
  modified_base (201)..(201): a, c, t, g, unknown or other
  misc_feature (201)..(201): n is a, c, g, or t
  modified_base (360)..(360): a, c, t, g, unknown or other
  misc_feature (360)..(360): n is a, c, g, or t
  modified_base (383)..(383): a, c, t, g, unknown or other
  misc_feature (383)..(383): n is a, c, g, or t
  modified_base (414)..(414): a, c, t, g, unknown or other
  misc_feature (414)..(414): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaacctggccaggctcccagtctcctcatctatggggcatcctacaggatgaccggcatcccagacaggttcagtgccagtggtctgggacagacttcnctctcaccatcaacacactggcncctgaagtatttgctagtgtattctgtcagntgtatggtagtcacgtacactttggccgagggccaaggtggatagtcagacgaactggtcgacgtgacaacgatcgtagtcctcgactccttcccg

SEQ ID NO: 324317 - DNA, 503 bp, Homo sapiens
  misc_feature: GZ8MTXP02I40EE.21.38.D05.1.454.CMB.2.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (405)..(405): a, c, t, g, unknown or other
  misc_feature (405)..(405): n is a, c, g, or t
  modified_base (453)..(453): a, c, t, g, unknown or other
  misc_feature (453)..(453): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctccagtctctcatctatgggcatcctacaggatgaccgnatcccagacaggttcagtgccagtgggctgggacagacttcactctcaccagtcaacncacngcnctagatattgatatatatactgtanagatgtagtggtagtactacgtactacgttgacgaagggacaggtganacacgagacgagtgtacgctagacaacactctactactactactactccg

SEQ ID NO: 324318 - DNA, 528 bp, Homo sapiens
  misc_feature: GZ8MTXP02JQ0WK.21.38.D05.1.454.CMB.2.raw
  modified_base (205)..(205): a, c, t, g, unknown or other
  misc_feature (205)..(205): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcactcccagacaggttcagtgccccagtgggtcgtgggacagactcactctcaccatcaacacactggcgcctagaagtattttgactagtgttattactgtcagtatgtagtggtaggtacaccgtactaccgtttggaccgtaggggaccaagggtgacgatcgaacgacgaacgtgacgctgcacatctagtcttcgatttcccg

SEQ ID NO: 324319 - DNA, 525 bp, Homo sapiens
  misc_feature: GZ8MTXP02HNSCM.21.38.D05.1.454.CMB.2.raw
  modified_base (205)..(205): a, c, t, g, unknown or other
  misc_feature (205)..(205): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgcccaggtggtctgggacagacttcactcncacatcaacacactgcnctagaanattttgctagttcgtaattactgtacagtattgttatgggtaggtcaccgtactacgtttgccgaggggaccaagggtggagatcaagacgaaactggtacgctagaacaccgtatcgtatcttctattccc

SEQ ID NO: 324320 - DNA, 520 bp, Homo sapiens
  misc_feature: GZ8MTXP02JYG7Y.21.38.D05.1.454.CMB.2.raw
  modified_base (205)..(205): a, c, t, g, unknown or other
  misc_feature (205)..(205): n is a, c, g, or t
  modified_base (386)..(386): a, c, t, g, unknown or other
  misc_feature (386)..(386): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctccagtctcctcatctatggggcatcctacaggatgaccggcatcccagacagttcagtgcccagtggtctgggacagacttcactctcaccatcaaacacactggcncctgaacgtattttgctaagttgtaattactgtcaagatagtatgggtaggttcaaccgtacaccgtttggccaggggaccaagggtcgaagatcaggaaccgaaactcgtgctgcacatctgtcttcacttcc

SEQ ID NO: 324321 - DNA, 568 bp, Homo sapiens
  misc_feature: GZ8MTXP02F3CCX.21.38.D05.1.454.CMB.2.raw
  modified_base (205)..(205): a, c, t, g, unknown or other
  misc_feature (205)..(205): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgagttgcctggtaccaaacaaaacctggccaggctcccagtctcctcatctatggggcatcctacaggatgaccggcactcccagacagttcagtgccccagtcgggtctggggacagacttcactctcaccatacaaacacactgccgcctagaagtattttgctagtgttattacgtgtacagtatgttagtgggttaagtcctaaccgtactaccgtttggaccggtaaggggacctaaaggggtcggaaggactacgaaacggaccggtaaacgtggtacggactgaacgacctattcgtgttcttctaactttccccg

SEQ ID NO: 324322 - DNA, 585 bp, Homo sapiens
  misc_feature: GZ8MTXP02I1JRN.21.38.D05.1.454.CMB.2.raw
  modified_base (202)..(202): a, c, t, g, unknown or other
  misc_feature (202)..(202): n is a, c, g, or t
  modified_base (379)..(379): a, c, t, g, unknown or other
  misc_feature (379)..(379): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgtgcatcgagttgcctggtaaccaacaaaactggccaggctccagtctcctcatctatggggcatcctacaggatgaccggcatcccagactaggtcagtcgccaggtcgggtctgggacagtacttcgactctacaccatcaaacncactcgccactgaacgtatttgactaggtattattacgtgtactaaggtattaggtagttggtaaggtacctaaccgttacctaaccgtttcgggaccgtaagggggtaccctaaaggggtcggaaacgtacgttacgaaaggtacggtaaacggtgttacgggctggaccaacctacgtcttcgtctttcaacttccgttccccg

SEQ ID NO: 324323 - DNA, 611 bp, Homo sapiens
  misc_feature: GZ8MTXP02HUAT8.21.38.D05.1.454.CMB.2.raw
  modified_base (202)..(202): a, c, t, g, unknown or other
  misc_feature (202)..(202): n is a, c, g, or t
  modified_base (364)..(364): a, c, t, g, unknown or other
  misc_feature (364)..(364): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagtagtgttggctatcgacgttgcctggtaaccaacaaaactggaccaggctaccagtctcctcatctagtgggctatcctacaggatcgacgcactcccagacagtcagtgcaggtggtctgggactagtacttcnctctacacctactacaacactactcgacaccgtagaagtacttttgacgtagttagttaacgttactacgtacgtaagttagttaggttaacgttagggtaacggttaccgtaacccggttaaccgtaccggtttacggggacccgtaagggggtaaccgtaaggggtacggaagtactacggaaaggtaacgtacggtagtcggacgtcgactaacgtatcgtctacttactacgtttcctacccg

SEQ ID NO: 324324 - DNA, 553 bp, Homo sapiens
  misc_feature: GZ8MTXP02FO7JB.21.38.D05.1.454.CMB.2.raw
  modified_base (359)..(359): a, c, t, g, unknown or other
  misc_feature (359)..(359): n is a, c, g, or t
  modified_base (410)..(410): a, c, t, g, unknown or other
  misc_feature (410)..(410): n is a, c, g, or t
  modified_base (472)..(472): a, c, t, g, unknown or other
  misc_feature (472)..(472): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaaggggaaaaattctctctcctgcaaggccagtcagagtgttggcatcgacgttgcctggtaaccaaacaaaactggccaggctcccagtctcctcatctagtggggcagtcctacaggatcgaccggcatcccagacaggttcagtgccagtcgggtctggganagtactcactctcacatacaacacactgcgctagaagtattttgactagtntaattactagtcagtatgtatggtagtctacgtacacgttgacgtaggggaccaaggtgganagtacgacggaagtaaaccgtggtacgggcttacggccgtaaaactcgttctacgttacctactaccttcccgtacccacg

SEQ ID NO: 324325 - DNA, 544 bp, Homo sapiens
  misc_feature: GZ8MTXP02F68OQ.21.38.D05.1.454.CMB.2.raw
  modified_base (204)..(204): a, c, t, g, unknown or other
  misc_feature (204)..(204): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (488)..(488): a, c, t, g, unknown or other
  misc_feature (488)..(488): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctggtaccaaacaaaacctggccaggctcccagtctcctcatctagtggggcatcctacaggatcgaccggcactcccagacaggttcagtgccaggtgggtctgggacagtaccttcactctacaccataccaacacactggccncctagaagtnttttgctagtgtattacngtacagtatgtagtgggtacgtacaccgtactaccgtttggaccgaggggaccaaggtggaanagtacgagacgtactggtcgactgacaactacgtctacgtcttcacgttcctcccg

SEQ ID NO: 324326 - DNA, 551 bp, Homo sapiens
  misc_feature: GZ8MTXP02GV1PL.21.38.D05.1.454.CMB.2.raw
  modified_base (203)..(203): a, c, t, g, unknown or other
  misc_feature (203)..(203): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaaccaacaaaaacctggccaggctcccagtctcctcatctatggggcatcctacaggatgaccggcatcccagacaggttcagtgccagtgggtctgggacagtacttcactctcaccatcaaacacactgcgcctagaagtatttgctagtgttaattactgtcaagattgtagttggtaggtacacccggtactacccgtttgggacccgtaagggggaacccaagggtggacgtaatcgaaagacgtaaacgtgtacggactgacaacatcgtcgctttcacttccgtcccc

SEQ ID NO: 324327 - DNA, 595 bp, Homo sapiens
  misc_feature: GZ8MTXP02G7DCF.21.38.D05.1.454.CMB.2.raw
  modified_base (203)..(203): a, c, t, g, unknown or other
  misc_feature (203)..(203): n is a, c, g, or t
  modified_base (367)..(367): a, c, t, g, unknown or other
  misc_feature (367)..(367): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaactggccaggctccagtctcctcatctatcggggctactcctacaggatcgaccggcactcccagacaggtcagtgccaggtgggtctggggacagacttcnctctcaccatacaacacactcgctacctagaatatttgactagttgttaattacgtagtctaagtattgtaacgttggtacggtacctaacccgtacgtaccgtttacggaccgtaacggggaaccgtaagggtacggaacgtaacgttacgaacggaacgtaaacgtggtacgggcttacggacctaaccgtattaccgtacgttctacctaacttcccggttcccc

SEQ ID NO: 324328 - DNA, 556 bp, Homo sapiens
  misc_feature: GZ8MTXP02J0GJN.21.38.D05.1.454.CMB.2.raw
  modified_base (206)..(206): a, c, t, g, unknown or other
  misc_feature (206)..(206): n is a, c, g, or t
  modified_base (289)..(289): a, c, t, g, unknown or other
  misc_feature (289)..(289): n is a, c, g, or t
  modified_base (547)..(547): a, c, t, g, unknown or other
  misc_feature (547)..(547): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaacctggccaggctcccagtcncctcatctagtggggcatcctacaggatggaccgcatcccagacaggtcagtgcccagtggtctggggacagactcactctcacatcaaacacactgcgctagaagtctttgctagtgtaattactgtacagtattgtagtggtacggtctaaccgtacttaccgttgggaccgaagggggacctaaaggggtaggacgaaactcgaaggtaacgaacgtcggacggcctagcctaccgtattcgttgtccttaaccngtttccccg

SEQ ID NO: 324329 - DNA, 576 bp, Homo sapiens
  misc_feature: GZ8MTXP02GKILN.21.38.D05.1.454.CMB.2.raw
  modified_base (204)..(204): a, c, t, g, unknown or other
  misc_feature (204)..(204): n is a, c, g, or t
  modified_base (315)..(315): a, c, t, g, unknown or other
  misc_feature (315)..(315): n is a, c, g, or t
  modified_base (373)..(373): a, c, t, g, unknown or other
  misc_feature (373)..(373): n is a, c, g, or t
  modified_base (407)..(407): a, c, t, g, unknown or other
  misc_feature (407)..(407): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaanagttactctctcctgcaaggccagtcagagtgttggcatcgacgttgcctaggtaaccaaacaaaaacctggccaggctcccagtcctcctcatctagtggggcatcctanaggatggaccggcactcccagacgagttcagtgccaggtgggtctgggacagacttcnctctcacatcaacacactggctcctagaaacgtnttttgctagttgttaattactagtctaagtagttgtagttagggtacgtacctaaccgtaccgtaccgtttaggacccgtaaggggacccgtaagggtggaagtacgtacgaaggacgtaacgtggtacggctcgacaacgtatcgtcgtacttacacttcgttccccg

SEQ ID NO: 324330 - DNA, 540 bp, Homo sapiens
  misc_feature: GZ8MTXP02HNIGT.21.38.D05.1.454.CMB.2.raw
  modified_base (199)..(199): a, c, t, g, unknown or other
  misc_feature (199)..(199): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
  modified_base (519)..(519): a, c, t, g, unknown or other
  misc_feature (519)..(519): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctccaggtgtcaccggagaagttgtcttgacgcagtctccaggcacctgtctctgtctcgaagggaaangttactctctcctgcaaggccagtcagagtgttggcatcgagttgcctaggtaaccaacaaaacctggccaggctccagtctcctcatctatggggcatcctacaggatgaccggcactcccagacaggttcagtcgcacggtgggtctggggacaggtacttcactctacaccatacaacacactcgcnccctagaactntttgctagttgtattactgtacagtattgtagttggtagtacaccgtactaccgtttggaccgtaggggaacctagggtgaagtactacgagaacgacgtgtcggactaggcaaccgtntctcgtcttcacttcttcccg

SEQ ID NO: 324331 - DNA, 598 bp, Homo sapiens
  misc_feature: GZ8MTXP02GHJK0.21.38.D05.1.454.CMB.2.raw
  modified_base (205)..(205): a, c, t, g, unknown or other
  misc_feature (205)..(205): n is a, c, g, or t
  modified_base (576)..(576): a, c, t, g, unknown or other
  misc_feature (576)..(576): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctaggtaacccaaacaaaacctggaccaggcctcccagtctcctcatctatgggcatcctacaggatcgaccggcactcccagacaggttcagtgccccaggtcggtctggggacagacttcactctacaccatacaaacacactgctcctagaagtattttacgctaagttgttaacttacgtgttacgaagtagtagttagtggttaacggtactaacccgtacgtaccgtttcgggacccgtaggggaaccgtaaggtggaagacgtacgaacggaacgaaacgttcggtacggacctaggaacctaacccgtagttccncgtttacctacgactttccccg

SEQ ID NO: 324332 - DNA, 606 bp, Homo sapiens
  misc_feature: GZ8MTXP02H5SIV.21.38.D05.1.454.CMB.2.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (339)..(339): a, c, t, g, unknown or other
  misc_feature (339)..(339): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctccaggtgtcaccggagaagttgtcttgacgcagtctccaggcacctgtctctgtctcgagggaangttacnctctctgcaaggcagtcagagtgttggcatcgagttcgcctaggtaaccaaacaaaacctggccaggcctccagtctcctcatctagtgggcatcctacaggactgaccggcactccgagacaggtcagtcgcnggtggtcgtagggacagtacttcgctcgtacaccatacaacacactcgcgctagagtattgctagtgttactacgttgactgtattgtaagttcggtaggtacctaaccggttactaaccggtttacggaccggaagggggtaacccgtaaggggtacggaaacggtagttaaccgaagggtaaaccgtaaaacggttggttacgggaccgttacggaacctaaccgtaacgtcgttactccgtttacacggtttccctaaccccgg

SEQ ID NO: 324333 - DNA, 544 bp, Homo sapiens
  misc_feature: GZ8MTXP02I6WP8.21.38.D05.1.454.CMB.2.raw
  modified_base (203)..(203): a, c, t, g, unknown or other
  misc_feature (203)..(203): n is a, c, g, or t
  modified_base (332)..(332): a, c, t, g, unknown or other
  misc_feature (332)..(332): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaaccaacaaaacctggccaggctcccagtctcctcatctatggggcatcctacaggatgaccggcactcccagacnggttcagtgccagtggggtctgggacagacttcactctcaccatcaacacactgcacctgaacgtattttgctagtgtattacgntcagtntgtatggtaggtcaccgtacaccgtttgggacctaagggggacctaaagggtggaagtacgtagacggaacgtaaacgtgtcggactgacgaaccattcctatcgtctactccgttacccg

SEQ ID NO: 324334 - DNA, 543 bp, Homo sapiens
  misc_feature: GZ8MTXP02FK1H4.21.38.D05.1.454.CMB.2.raw
  modified_base (201)..(201): a, c, t, g, unknown or other
  misc_feature (201)..(201): n is a, c, g, or t
  modified_base (304)..(304): a, c, t, g, unknown or other
  misc_feature (304)..(304): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgagttgcctggtaaccaacaaaacctggaccaggctccagtctcctcatctatgggcatcctanaggatggaccggcatccccagacgaggttcagtgccaggtggggtcngggacagacttcnctctcaccatccaacacactgcncctgaatntttgcagttgtattactgtcagtatagtagtggtacgtcaccgttactaccgtttcggcgaacggggacaagggtcgaagtactacgaggacgtaaacgtggtacggactggacaacctgtctcgtactttacacttcccgttacccg

SEQ ID NO: 324335 - DNA, 553 bp, Homo sapiens
  misc_feature: GZ8MTXP02G39VH.21.38.D05.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (402)..(402): a, c, t, g, unknown or other
  misc_feature (402)..(402): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttacnctctcctgcaaggccagtcagagtgttggcatcgacgtttgccctaggtaccaacaaaacctggccaggctcccgagtctcctcatctaatggggcatcctacaggatgaccggcatcccagacaggttcagtgccccgagtgggtctggggacagacttcgactcgtcaccgatacaacacactaggccnctagaagtattttacgcgtagtagtacttactgtacagtatagttagtgggttacgtcaccgtactaccgtttggacgtagggtaccaaggtcgtagagtcagtacgaacgtgtcgctgaacgacctaatcgtagtcttactacgttcccg

SEQ ID NO: 324336 - DNA, 611 bp, Homo sapiens
  misc_feature: GZ8MTXP02GFK2A.21.38.D05.1.454.CMB.2.raw
  modified_base (204)..(204): a, c, t, g, unknown or other
  misc_feature (204)..(204): n is a, c, g, or t
  modified_base (374)..(374): a, c, t, g, unknown or other
  misc_feature (374)..(374): n is a, c, g, or t
  modified_base (400)..(400): a, c, t, g, unknown or other
  misc_feature (400)..(400): n is a, c, g, or t
  modified_base (442)..(442): a, c, t, g, unknown or other
  misc_feature (442)..(442): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccgggagaagttgtcttgacgcagtctccaggcaccctgtctctgtctccaggggaaangttactctctcctgcaaggccagtcagagtgttggcatcgacgttgcctggtaaccaaacaaaacctggaccaggctccagtctcctcatctagtggggcatcctacgaggactgaccggcactcccagacgtaggttcagtgccgagtgggtcgtgggacagtacttcnctctacaccatacaacacactcggcncctagaagtattttgactagttgtaatttacgtgtcgaagtnttaggtagttgggtacggtaccgtacccgttaacgtacccgtttggacccggtaagggggacctaaaggggtggaagtaacttacggaacgtaacggtaaacgtcggtagggactacggacccgtaactagttaccgtacgttacctcttaaccttcccgtttaccccg

SEQ ID NO: 324337 - DNA, 661 bp, Homo sapiens
  misc_feature: GZ8MTXP02HPY6T.21.38.D05.1.454.CMB.2.raw
  modified_base (205)..(205): a, c, t, g, unknown or other
  misc_feature (205)..(205): n is a, c, g, or t
  modified_base (320)..(320): a, c, t, g, unknown or other
  misc_feature (320)..(320): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctcaggggaaangttactctctcctgcaaggccagtcagagtgttggcatcggacgttgcctaggtaacccaaacaaaaccgtggacccaggcctcccagtcctcctcatctagtgggcactcctanaggatgaccgcactcccagacaggttcagtcgcccgtaggtcggtcgtaggggacaggtaccttcgacttcctacaacctataccaaacaccacgtcggccgtaccgtagaaagttagtttttaggaccttaggttattaactttacgtggtactagtagttaggttaagtaggttacgggtacctaaacccggttacttaccggtttacggggacccgaaagggggtaacccgaaggggttacggaagtacgttacgaacggtaaacggtaaacgttggggtcggtactacggaaccgtacctagtttccgtcgtttacccttcttaaaccgtttccccg

SEQ ID NO: 324338 - DNA, 573 bp, Homo sapiens
  misc_feature: GZ8MTXP02F2FZ6.21.38.D05.1.454.CMB.2.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcacctgtctctgtctccaggggaaangttactctctcctgcaaggccagtcagagtgttggcatcgacgttgcctaggtaaccaacaaaaacctggccaggctcccagtctcctcatctatggggctatcctanaggatgaccggcatcccagacagttcagtgccagtggtctgggacagacttcnctctcacatcaacncactgccnctagaatatttgcagtntattacngtacagtntagtatggtacgtacgtacctacgtaccgttggaccgtaaggggaccaaggggtcggaagtaacgtcgaaggtaacggaaaccttgggtcgaccgttacggacctaacccgtagttccttcggttacctttaccgaacgttttcccgttacccccg

SEQ ID NO: 324339 - DNA, 679 bp, Homo sapiens
  misc_feature: GZ8MTXP02HS691.21.38.D05.1.454.CMB.2.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (465)..(465): a, c, t, g, unknown or other
  misc_feature (465)..(465): n is a, c, g, or t
  modified_base (628)..(628): a, c, t, g, unknown or other
  misc_feature (628)..(628): n is a, c, g, or t
  modified_base (641)..(641): a, c, t, g, unknown or other
  misc_feature (641)..(641): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagtttacncctctcgtcgacgacgactagtacgagtagttggtcgactacgtacggtacgtcgtccgtacgaaaccaaaactaaaccggtcgacgcggtcccctaccgtacgtccctacctactacttaccgttaggggcggactaccgttaacccgtacggaagttacgaccggacccgactaccccgtacccgaacgtaacggttcggtacgtaggtccgacggtacggggttcggtacggtacggacacgttaccttcnccgtctaaccactactaacacgactacggcgcctacgtaaagtactttagtcgacgtagttagttactacgtcgtagtaagtgtttagtaggtttacggactaccgtaccgttacttacggtcggacgggacggtaacagggtacgaatcgtacaggtaaacnggttagcgtacgngacctaagtcgtcgttaccgtctactcctttccgaccc

SEQ ID NO: 324340 - DNA, 622 bp, Homo sapiens
  misc_feature: GZ8MTXP02GHW5B.21.38.D05.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctccaggtgtcaccggagaagttgtcttgacgcagtctccaggcaccctatctctgtctccgaggggaaanagttactctctcctgcaaggccagtcagagtgttgcagtcgacgttgcctaggtaaccaaacaaaaccgtcggaccaggcctaccagtcctcctcatctagtggggcactacctacgaggatcggacgcactcccagacgtaggttcagtcgcacggtgggtcgtagggacagtacttcactctacaccataccaaacacacgtacgccgacgtagaagtagtttagtacgtagttagttagttacgttagtacgtaagtagttagttagttagggttacggtaccgtaccgtaaccgttaccggttacggtacggaacgggtaccggtaagggtaggtaagacgtacgaagtaacccccccgtaagtacggtcggtacgtcgacaacgtacgtcttacgttcttactacttaccttcccg

SEQ ID NO: 324341 - DNA, 598 bp, Homo sapiens
  misc_feature: GZ8MTXP02JADA9.21.38.D05.1.454.CMB.2.raw
  modified_base (201)..(201): a, c, t, g, unknown or other
  misc_feature (201)..(201): n is a, c, g, or t
  modified_base (417)..(417): a, c, t, g, unknown or other
  misc_feature (417)..(417): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcactccccagacaggtcagtgccagtgggtctggggacagacttcactctacaccatacaacacacgtacgcgccttaggaagtatttttgacgtaggttntaacttacgtgtacagtatgtaacgttgggtagttaccgtaccgttactaaccgtttcgggaccgtacgggggacctaaaggggtggaacgtacgtacgaaggacggtaaacgtggtacgggtctacggaccaaccggtattccggttacgtcctttaaccgactttacccgtttcccccg

SEQ ID NO: 324342 - DNA, 535 bp, Homo sapiens
  misc_feature: GZ8MTXP02FG4T3.21.38.D05.1.454.CMB.2.raw
  modified_base (203)..(203): a, c, t, g, unknown or other
  misc_feature (203)..(203): n is a, c, g, or t
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaaacctggccaggctccccagtctcctcatctatggggcatcctacaggatgaccggcatcccagacaggttcagtgccagtggtctgggacagacttcactctacaccatcaaacacactggcncctgaagtnttttgcagtgtattctgtcagatgtatggtagtcaccgtacaccgtttggaccgtaggggaccaagggtgagactcgagaacgaactggtcggctcgacaacctagttctacgtcctttacgacttcccgttacccg

SEQ ID NO: 324343 - DNA, 684 bp, Homo sapiens
  misc_feature: GZ8MTXP02H0FRB.21.38.D05.1.454.CMB.2.raw
  modified_base (204)..(204): a, c, t, g, unknown or other
  misc_feature (204)..(204): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgagttgcctaggtaaccaaacaaaaccgtggaccaggcctccagtcctacctcatctagtgggcatcctacgaggatacggaccggcactcccagactaggtcagtgccgaggtggtacgtgggactagtaccttcacgtctacaccacgtaccaacactacgtcgacctccgtagaacgttagtttcgacgtagttacgttaaacttccgtagtactaagtagttaggttaagttagggtacggttaccgtaaccggttaccttaacccgggtttggaacccgggtaagggggtaaacccgtaaagggggttacggaaacggtacgttaccggaacggtaaaccggtaaacggttcgggtaacggtccctaccgggtacctaaccgtaacgtttacgtccggtttacctttaacccaccgtttacccccgtttaccccgg

SEQ ID NO: 324344 - DNA, 561 bp, Homo sapiens
  misc_feature: GZ8MTXP02IVQPG.21.38.D05.1.454.CMB.2.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
  modified_base (391)..(391): a, c, t, g, unknown or other
  misc_feature (391)..(391): n is a, c, g, or t
  modified_base (418)..(418): a, c, t, g, unknown or other
  misc_feature (418)..(418): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcagtcgacgttgcctaggtaccaacaaaaacctggccaggctccagtctcctnatctatggggcatcctacaggatgaccggcactccccagacacggtcaggtagccagtgggtctggggacaggtacttcgctctcaccatcaacacactgcncctgaagattttgctagtgtattacgngttcagtattgtagttagggtacgtacgtaacccgtactaccgtttggccgtaagggggacctaagggtgggaagacgtgaacggacgaaaccgtggtcgtacgcgtaccgaactagttcgtacgttctctacttccgtcccg

SEQ ID NO: 324345 - DNA, 592 bp, Homo sapiens
  misc_feature: GZ8MTXP02HS1RJ.21.38.D05.1.454.CMB.2.raw
  modified_base (208)..(208): a, c, t, g, unknown or other
  misc_feature (208)..(208): n is a, c, g, or t
  modified_base (403)..(403): a, c, t, g, unknown or other
  misc_feature (403)..(403): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccgggagaagttgtcttgacgcagtctccaggcaccctgtctctgtctccgaggggaaangttactctctcctgcaaggccagtcagagtgttggctagtcgtacgttgcctaggtaaccaaacaaaaccgtggaccaggcctcccagtcctcctcactctagtgggcatcctacgaggatgaccggcactcccagacaggttcagtcgcccgaggtcggtcgtgggacagacttcactctacaccatacaaacncactgcgcctagaagtatttgactagtagtattactgtactagtatagttagtggtacggtactagtacccccctagttcggaccgtaaggggaccgtaagggtacggagtacgtacgaaacggtaacgtaacgtggtacggacgtacgaacctacgtacttcgtacgttaccttactacgtttccccg

SEQ ID NO: 324346 - DNA, 512 bp, Homo sapiens
  misc_feature: GZ8MTXP02F3V9Z.21.38.D05.1.454.CMB.2.raw
  modified_base (325)..(325): a, c, t, g, unknown or other
  misc_feature (325)..(325): n is a, c, g, or t
  modified_base (392)..(392): a, c, t, g, unknown or other
  misc_feature (392)..(392): n is a, c, g, or t
  modified_base (444)..(444): a, c, t, g, unknown or other
  misc_feature (444)..(444): n is a, c, g, or t
  modified_base (465)..(465): a, c, t, g, unknown or other
  misc_feature (465)..(465): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaaggggaaagagttactctctcctgcaaggccagtcagagtgttggcatcgacgttgcctggtaaccaaacaaaaacctggaccaggctcccagtctcctcatctatggggcatcctacaggatgaccggnatcccagacaggttcagtgccagtgggtctggggacagacttcactctcacatcaaacacactggcncctagaacgtatttgcagtgtattactgtcagatgtatggtagtcacgtacncttgcgtagggacaaggtganactcagacgaacgtgtgactgcaacgatctcgtcttcactcctcccg

SEQ ID NO: 324347 - DNA, 573 bp, Homo sapiens
  misc_feature: GZ8MTXP02JIAU4.21.38.D05.1.454.CMB.2.raw
  modified_base (203)..(203): a, c, t, g, unknown or other
  misc_feature (203)..(203): n is a, c, g, or t
  modified_base (359)..(359): a, c, t, g, unknown or other
  misc_feature (359)..(359): n is a, c, g, or t
  modified_base (542)..(542): a, c, t, g, unknown or other
  misc_feature (542)..(542): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaacccaacaaaaacctggaccaggctcccagtctcctcatctatgggcatcctaacagatcgaccggcatacccagacaggttcagtgcaggtggctgggacngtacttcactctcaaccatacaaacacactggcctacctagaaaggtacttttagactagttcgttaatttactgtactaggattaggtattgggtaacggtactaccgtaccgtaacgtttcgggacctagggggaaccaagggtacgaaggacttcgaaggacgaaactcggtagtaccgngacaactatctcgtctcgtacttcctacccg

SEQ ID NO: 324348 - DNA, 525 bp, Homo sapiens
  misc_feature: GZ8MTXP02GUZKL.21.38.D05.1.454.CMB.2.raw
  modified_base (201)..(201): a, c, t, g, unknown or other
  misc_feature (201)..(201): n is a, c, g, or t
  modified_base (362)..(362): a, c, t, g, unknown or other
  misc_feature (362)..(362): n is a, c, g, or t
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaaacctggccaggctcccagtctcctcatctatggggcatcctacaggatgaccggcatcccagacaggttcagtgcacgtgggtctgggacagacttcnctctcaccatcaacacactgcncctagaacgattttgctagtgtattactgtcanatgtatggtagtcacgtactacctttggccgacggggacaagggtggaagtatacgaggaacgaaacgtggtagctgccaacgatctcgtcttcacttccgtaccccg

SEQ ID NO: 324349 - DNA, 757 bp, Homo sapiens
  misc_feature: GZ8MTXP02GD9IG.21.38.D05.1.454.CMB.2.raw
  modified_base (204)..(204): a, c, t, g, unknown or other
  misc_feature (204)..(204): n is a, c, g, or t
  modified_base (454)..(454): a, c, t, g, unknown or other
  misc_feature (454)..(454): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcagtcgacgttgcctaggtaaccaaacaaaacctggaccaggcctacccagtcctcctcactcgtagtcgggactatcctaacgaggatacggaccggcaacgtcccgaagacgtaggttacacggtcgaccgtaggtcgggtacgtaggggactaggtaccttcaccgtctaccacctataccaacacacgtcggccgtacctaggaaacgttnttttacggacgttacggtttagttaaacgtttacgtaggttaccgtaaaggttagtttagggtttaacgggtttagggggttaaaccggtttacccggttaaaccccggttaaccgttaacccgggttttacgggggaacccgggttaaacgggggtaaacccgtaaagggggtacgggtaaacggtaacgttaaccggaaacggggtaaaccggtaaaggttcgggtaaacggcgttaccggacctaaacccgtagttccgttacgttacctttaccgtaacctttccccggtttacccccg

SEQ ID NO: 324350 - DNA, 587 bp, Homo sapiens
  misc_feature: GZ8MTXP02GV6K3.21.38.D05.1.454.CMB.2.raw
  modified_base (206)..(206): a, c, t, g, unknown or other
  misc_feature (206)..(206): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
  modified_base (427)..(427): a, c, t, g, unknown or other
  misc_feature (427)..(427): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgagttgctggtacaacaaaacctgcaggctccagtctctcatctagtgggcatcctacgaggactcgaccggcactcccaagactacggttcagtcgccccgtaggtcggtcgtgggactaggtacttcactctcgaccatacaaacncactcggcncgtagaacgttatttgacgtagttnttaattacgtgtacagtagttgtaagtgggtacgtactaacccgtactacccgtttggaccgtaacgggtaccaaggggtgaaacgtacgacaacggttaacgaacgtgtacggtcctaggaacccaacgtacttacgtcgtacttaccgtactttcccc

SEQ ID NO: 324351 - DNA, 741 bp, Homo sapiens
  misc_feature: GZ8MTXP02G43GX.21.38.D05.1.454.CMB.2.raw
  modified_base (208)..(208): a, c, t, g, unknown or other
  misc_feature (208)..(208): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaangttactctctcctgcaaggccagtcagagtgttggcatcgacgttgcctagtaacaaacaaaacctggaccacggcctccagtctcctcatctagtgggcatcctacaggactaggaccggcacgtacccgagacgtacggtttacaggtacgaccccgtagggtcgggtacgtacggggactaggtaacctttccacttccgtaccaaccctactaccaaaaccacctaccgtacgggacccgtaccgtaggtaaacggttatttttagaccgtaattacggtttaactttaccgtggttaaactaggtaagtttaggttaagttacggggttaacgggttacccttaaccggttaaccgtaacccgggtttttacgggaacccgggttaacgggggaaccgttaaagggggttacggaaaacgtacggttaaccgaagggtaaacccggtaggttacgggtaacggtccgttagggaacccgtaaacctacgttaccggttcgtttacctttaccgtaacttttcccccgg

SEQ ID NO: 324352 - DNA, 523 bp, Homo sapiens
  misc_feature: GZ8MTXP02FG7PF.21.38.D05.1.454.CMB.2.raw
  modified_base (205)..(205): a, c, t, g, unknown or other
  misc_feature (205)..(205): n is a, c, g, or t
  modified_base (403)..(403): a, c, t, g, unknown or other
  misc_feature (403)..(403): n is a, c, g, or t
tcagtcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttgcatcgacgttgcctggtaccaacaaaacctggccaggctccagtctcctcatctatggggcatcctacaggatgaccggcatcccagacaggtcagtgcccagtgggtctggggacagacttcactctcaccatcaacacactgcgcctgagattttgctagtntattactgtacagatgtatggtaggtcaccgtacaccgtttggcctaggggacctaagggtcggagatacgaagacgaaacgtgtaggctagcaacgtactactgtacttacgatttccc

SEQ ID NO: 324353 - DNA, 590 bp, Homo sapiens
  misc_feature: GZ8MTXP02JGID9.21.38.D05.1.454.CMB.2.raw
  modified_base (207)..(207): a, c, t, g, unknown or other
  misc_feature (207)..(207): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttgcatcgagttgcctggtaccaacaaaacctggccaggctccagtctcctcatctatggggcatcctacaggatcgaccggcactcccagactaggtccaggtacgcccgtaggtcgggtcgtggggacacggtacttcgactctaccaccatacaaactacaaccgtgaccgtcctaggtaacttgttttcgctaggttgttacttacgtgtacgagtagtgttaagtggtacggtaccacgtactcgttggacgaggggtaccagggtggactagtcgaaggacgtaacgttggacggtcctaggaaccctaaacgcgttaccggtatttaccttctaactttcccccg

SEQ ID NO: 324354 - DNA, 715 bp, Homo sapiens
  misc_feature: GZ8MTXP02G5R20.21.38.D05.1.454.CMB.2.raw
  modified_base (203)..(203): a, c, t, g, unknown or other
  misc_feature (203)..(203): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaangttactctctctgcaaggccagtcagtagtgttggctatcgtagttgcctaggtaaccaaacaaaactggaccaggcctaccagtcctcctctatctagtgggactactccgtacaggactcggaccggtacacgtccccagacgtaggttcacggtcgccgtaggtcggggtcgtacgggactacggtaccttcgtactcctacgaacctactaccaaaactaccaacgttcggacccgtacgtaacgtaaacgtacgtttttacgaccgttaggttaacgtttaacgttaaccgttaggttccgtaaagttagtttaggttagggtttaccggttaacgttacccgaaaccggtttaccgtacccgggtttaccgggaaccgggtaaacgggggttacccgtaaaggggtacggtaacggtaaactaaacggaacggtaaacgtaacggtacgggtcgtacgtccgaactaaccgtatccgttactccgtaactcccggtttacctcccg

SEQ ID NO: 324355 - DNA, 602 bp, Homo sapiens
  misc_feature: GZ8MTXP02HGDDS.21.38.D05.1.454.CMB.2.raw
  modified_base (208)..(208): a, c, t, g, unknown or other
  misc_feature (208)..(208): n is a, c, g, or t
  modified_base (538)..(538): a, c, t, g, unknown or other
  misc_feature (538)..(538): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccgggagaagttgtcttgacgcagtctccaggcaccctgtctctgtctccgaggggaaangttactctctcctgcaaggccagtcagagtgttggcatcgacgttgcctaggtaccaacaaaactggaccaggctccagtctcctcatctatggggcatcctacaggatcgaccggcactcccagacaggttcagtcgcccctaggtgggtctggggacacggtacttcgaacttctccacctatacaaacacaacgtcggaccgtcctagtaagtattttcgacgtagttgttaattactgttacagtatgttaagtcgggttacgtaccgtaaccgttaactccggtttacggaccggtaagggggtaccaaaggggttcggaaaggntaccgaacggtacgaacgttgacggtctacgaacaccgtaagtctacgtccttacactttcccg

SEQ ID NO: 324356 - DNA, 572 bp, Homo sapiens
  misc_feature: GZ8MTXP02IV9C7.21.38.D05.1.454.CMB.2.raw
  modified_base (206)..(206): a, c, t, g, unknown or other
  misc_feature (206)..(206): n is a, c, g, or t
  modified_base (324)..(324): a, c, t, g, unknown or other
  misc_feature (324)..(324): n is a, c, g, or t
  modified_base (395)..(395): a, c, t, g, unknown or other
  misc_feature (395)..(395): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcacctgtctctgtctccgaggggaaangttactctctcctgcaaggccagtcagagtgttggcatcgacgttgcctggtaaccaaacaaaacctggccaggctccagtctcctcatctagtggggcatcctacgagatgaccggnactccagacagttcagtcgccccaggtcgggtctaggggacagacttcactctacaccctatacaacaacncgtagccgctaggaacgttatttgctagtgttattacgtgtacagtagtagttagtgggttagtaccaacccgttctaccgtttggaccggaaggggtaaccgtaagggtacggaagtacgtacgaacgaacggtaacgtggtacgcgtagcgaactgttctagtccttcactttcc

SEQ ID NO: 324357 - DNA, 782 bp, Homo sapiens
  misc_feature: GZ8MTXP02HIIGU.21.38.D05.1.454.CMB.2.raw
  modified_base (201)..(201): a, c, t, g, unknown or other
  misc_feature (201)..(201): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctccaggtgtcaccggagaagttgtcttgacgcagtctccaggcaccctgtctctgtctcgaaggggaaanagttactctctcctgacaaggcagtcagtagtgttggcagtcgacgttcgccgtaggtaaccaaacaaaaaccgtggaccaaggcctaccccagtcctccctctactctagtcggggactacgtcctacgaggactacggaccggacacgtacccgaaaggacgtacggttcgagtcggtaccgaggttcggggtacgttacggggactacggaccttacctacctaccttacaaccctaacttacctaaaccaaccgtaaccggtacgggtacccgtacccgttaaagggtaaaccgtttattttaccggggacttaagggtttaacggtttaaactttacccggttaggttacgtaaaagggtttacgtttaggttaaacgggtttagggggtaacggtttaaaccccgtaaaccggtttaaaccgttaccgggttttaccggggaacccgggtaacgggggtaaacccggtaagggggttaacgaaacggtacgtaaacgtaaaccgggtaaacgaaaccggtttgggtaccgcgttacgactaacgtactcggtctactccgtactttccctacccg

SEQ ID NO: 324358 - DNA, 578 bp, Homo sapiens
  misc_feature: GZ8MTXP02GBO8H.21.38.D05.1.454.CMB.2.raw
  modified_base (207)..(207): a, c, t, g, unknown or other
  misc_feature (207)..(207): n is a, c, g, or t
  modified_base (414)..(414): a, c, t, g, unknown or other
  misc_feature (414)..(414): n is a, c, g, or t
  modified_base (553)..(553): a, c, t, g, unknown or other
  misc_feature (553)..(553): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaaggggaaangttactctctcctgcaaggccagtcagagtgttggcatcgacgttgcctgtaccaacaaaacctggccaggctcccagtctcctcatctagtgggcatcctacgaggatcggaccggcactcccagactaggttcagtgccccaggtgggtcgtggggacacgtacttccgacctctaccacctactacaaacactacgtcggaccncctagaaagttcttttggactagttagttaattaccgtgtacagtatgtagtggtagtcacgtactacgttggaccgagggaaccgtagggtgaacgagtacgaacgaaccggacgttgggacgcgtacggccgtaacncgttcgtcgtcttcgactttccccg

SEQ ID NO: 324359 - DNA, 702 bp, Homo sapiens
  misc_feature: GZ8MTXP02IIU8T.21.38.D05.1.454.CMB.2.raw
  modified_base (205)..(205): a, c, t, g, unknown or other
  misc_feature (205)..(205): n is a, c, g, or t
  modified_base (457)..(457): a, c, t, g, unknown or other
  misc_feature (457)..(457): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctcgaggggaanagttactctctcctgacaaggccagtcagagtgttggctatcgtacgttgccgtaggtaaccaaacaaaaccgtggaccacggcctacccagtcctacctcatcgtagtcgggactacgttccaagaggatcggaccgcactcccgagacgtaggttacaggtcgaccccgtaggtcgggtcgtgggactacgtacttcgactcgtaccaccactacaaacctacacgtcggaccgtaccgtagaaacgttntttttacgacgttaaggtttacgttaactttacgtacgttacctaaaggttattaacggtttagttacggggttaacgttacccctaaccggttaaccgttaacccggttttacggggacccggtaaagggggtaaccgtaaggggttaacggacgtaaacggtacgaaaacgtaacggtaaccgttagggaccgttagacggaacctacgacgtttcgtcgttaccttacgtaacgtttccccg

SEQ ID NO: 324360 - DNA, 546 bp, Homo sapiens
  misc_feature: GZ8MTXP02JBC21.21.38.D05.1.454.CMB.2.raw
  modified_base (203)..(203): a, c, t, g, unknown or other
  misc_feature (203)..(203): n is a, c, g, or t
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctacccagtctcctcatctatggggcatcctacaggatgaccggcactcccagacaggttcagtgccagtgggtctgggacngacttcactctcacatcaacacactgcncctagaagtatttgactagtgttattactgtctagatgtagtggtacgtctaccgtactaccgttggccgaggggacctaagggtggaagtacgtacgaaggacgtaacgtggtcggactcgacaaccgtagtctcgtcctttacgtactcctttaccccg

SEQ ID NO: 324361 - DNA, 602 bp, Homo sapiens
  misc_feature: GZ8MTXP02FOCVB.21.38.D05.1.454.CMB.2.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
  modified_base (571)..(571): a, c, t, g, unknown or other
  misc_feature (571)..(571): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaacctggccaggctcccagtctcctcatctatggggcatcctanaggatcgaccggcactcccagacgaggttcaggtcgccgaggtggggtctggggacaggacttacactcctacaacctactaccaaacaccacgtcgccgccctagtaacgtaattttgactagttgttaatttacgtgtacagtactggttagtagggttacggtacctaccgttacgtaccgtttggaccggtaggggaccgtaagggtggaacgtaagacgtaaggaccgtaagtggtacggtcgtacggaccaaccgtntaccgttcgtctttacgcttaccgttccccg

SEQ ID NO: 324362 - DNA, 582 bp, Homo sapiens
  misc_feature: GZ8MTXP02HACK8.21.38.D05.1.454.CMB.2.raw
  modified_base (205)..(205): a, c, t, g, unknown or other
  misc_feature (205)..(205): n is a, c, g, or t
  modified_base (396)..(396): a, c, t, g, unknown or other
  misc_feature (396)..(396): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaangttactctctcctgcaaggccagtcagagttgttggcatcgacgttgcctaggtaacccaaacaaaacctggaccaggcctccagtcctcctcactctagtgggactactccgtacaggatcggaccggcactcccgagtacgtaggttcagtgccgaggtgggtaccgtagggacagtaccttcacgtcncaccatacaacacacgtcgcaccgtagaagtatttcgactagttagttaacttacgtgtacagtagttagtagttggtacggtactaaccgtacgtaccgttagggacgtacgggtaccgaaggtgaacgactacgaagtaccgaagtgtacgctacgcaactatccgtatctactactccgtccg

SEQ ID NO: 324363 - DNA, 691 bp, Homo sapiens
  misc_feature: GZ8MTXP02JIRBM.21.38.D05.1.454.CMB.2.raw
  modified_base (207)..(207): a, c, t, g, unknown or other
  misc_feature (207)..(207): n is a, c, g, or t
  modified_base (681)..(681): a, c, t, g, unknown or other
  misc_feature (681)..(681): n is a, c, g, or t
tcagtcgtcgctcgcacgaccggtgctcgatttagtatctgatagttgggtttggggggagaagagctgctcagttaggacccagagggaaccatggaaaccccagagcagcttctcttcctcctgctactctggctcccaggtgtcaccggagaagttgtcttgacgcagtctccaggcaccctgtctctgtctccgaggggaaangttactctctcctgcaaggccagtcagagtgttggctagtcgacgttgcctggtaccaaacaaaaccgtgaccaggcctccgagtcctcctcatctagtggggcactcctacgaggactcgaccggctactccccgaagacgtacggttcgacgtcgccccgtaggttcggggtacgtacggggacgtaacgtacttccgtactctaccaacctactacaaacaccaccgttcggaccgtacccgtagtaacggttattttacgacgtaacggttagttaactttaacgtcggttaactaagtaagttaggtagttacgggttaacgtaccgtaaccggttacgttaccggtttacgggaccggtaacgggggtaaccgtaaggggtacggaacggtaacgtacggtaaacggtaacggtacgtacgggttcgaccgtagaaccgtaccgtacgttctacggttaccttaaccncgtttacccg

SEQ ID NO: 324364 - DNA, 585 bp, Homo sapiens
  misc_feature: GZ8MTXP02FPOWC.21.38.D05.1.454.CMB.2.raw
  modified_base (207)..(207): a, c, t, g, unknown or other
  misc_feature (207)..(207): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaanagttactctctcctgcaaggccagtcagagtgttggcatcgacgttgcctgtacaacaaaacctggccaggctcccagtctcctcatctagtggggcatcctanaggntaggccggcatcccaggacaggttcagtgccccgagtcgggtctagggacacggactttcgacctcnctaccntacaaacacaccgtggccgcctagaagtattttcgctagtgtattactgtcagtatgtagttgggtacgtacaccgttacaccgtttggacggtaggggtaaccagggtcggaagtacgtagtaacgaaccggtaattcgggtacgacgtacggtaaccaaacccgttataccgttgtaccgttactaccgttcccg

SEQ ID NO: 324365 - DNA, 630 bp, Homo sapiens
  misc_feature: GZ8MTXP02HV6K4.21.38.D05.1.454.CMB.2.raw
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
  modified_base (375)..(375): a, c, t, g, unknown or other
  misc_feature (375)..(375): n is a, c, g, or t
  modified_base (404)..(404): a, c, t, g, unknown or other
  misc_feature (404)..(404): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccgggagaagttgtcttgacgcagtctccaggcaccctgtctctgtctccgaggggaaatagttactctctcctgcaaggccagtcagagtgttggcatcgacgttgcctaggtaaccaaacaaaacctggaccaggcctccagtctcctnatctagtggggcatcctanaggatgaccggcactcccagtacaggttcagtcgccaggtggtcagggacaggtccttcnctctcaccatacaacacactggtcacccngtaagtattttgactagttgttaacttcgttgtacagtgttagttagtacgggttaggtacccgtaccgttaacctaccgtttacggggaccggtaacgggggtaaccgaaggggtacggtaaagtcggttaccgaaggaaacgtaaacggtaggtacggggtcttacgggacctaaacccgtggttaccttcggttacttaccgtaactttcccgttacccccgg

SEQ ID NO: 324366 - DNA, 548 bp, Homo sapiens
  misc_feature: GZ8MTXP02FFGJW.21.38.D05.1.454.CMB.2.raw
  modified_base (203)..(203): a, c, t, g, unknown or other
  misc_feature (203)..(203): n is a, c, g, or t
  modified_base (519)..(519): a, c, t, g, unknown or other
  misc_feature (519)..(519): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaaacctggccaggctcccagtcctcctcatctatggggcatccacaggatgaccggcatcccagacaggttcagtcgccagtgggtctggggacagacttcactctcacatcaacacactgcgccctagtaagattttgacagtgttaatttacgtgttacagtagtagtagtagggtacgtacaccgttacctaccgtttagggcccgtagggggaccaaagggtggaagtacacgagaacgaacttggcgtcngcaaccagtctgtcttcactccgttcccg

SEQ ID NO: 324367 - DNA, 750 bp, Homo sapiens
  misc_feature: GZ8MTXP02HLH1H.21.38.D05.1.454.CMB.2.raw
  modified_base (207)..(207): a, c, t, g, unknown or other
  misc_feature (207)..(207): n is a, c, g, or t
tcagtcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaanagttactctctcctgcaaggccagtcagagtgttggctagtcgtacgttgcctaggtaccaacaaaacctggaccaggcctccagtctcctacatctagtggggcatcctagaggtatcggaccggcactacccgagaccgtaggttacaggtcgccccgtagggtcgggtctaggggaactacggtacttccgactcttaccgaaccctataccaaaacctactaaccgtcgggaccctacccgttaggaaacgttacgtttttacggaccttaaggtttagttaaacgtttaccgtacgttaaacctaagggtaaatttgggtttaaacgttcgggttaacgggttaccccgtaacccggtttaacccgttacccggttttacggggaccccgggtaaacgggggtaacccggtaaagggggttaacggaaaggtaacgttaccggaaacggttaaaacccggacgtttagggacggtaccgttagggaaccctaacggtacttaccgtcggtttaccctttacggttaacctttccccgg

SEQ ID NO: 324368 - DNA, 746 bp, Homo sapiens
  misc_feature: GZ8MTXP02FNCM8.21.38.D05.1.454.CMB.2.raw
  modified_base (225)..(225): a, c, t, g, unknown or other
  misc_feature (225)..(225): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctccaggtgtcacggagaagttgtcttgacgcagtctccaggcacctgtctctgtctacgaggggaaatgttactctctcctgacaaggccagtnagtagttgttggctagtcgtacgttcgacctaggtaaaccaaaacgaaaaaccgtcggaccaacggtcctacccacggttcctacccgtactacttaccgtagtcggggacctaacttccgtaacggaaggtactcggaaccggtacctaacgtacccgaagacgtacggttacaggtcgacgtacgggtcgggtacgtaggtaaccgtagtaccttacctaccgtcctacgaacctactacgtaaacactacgtcgacgtacctagaaacgttgtttacgacgtagttacgttattacgtacgtagtaaaggtagtaaggtttagggtaacgggtttaccggtaaccgttaaacccgttaacccgttaccgggtttaacggggacccggggtaaacgggggtaaaccggtaaaaggggttcgggaaaacgtacgggttaaacccgaaagggaaaccgttaaccgtggggttaacgcgtacgtaccaacgtacttcggtacttcttacgcttccgtacccg

SEQ ID NO: 324369 - DNA, 644 bp, Homo sapiens
  misc_feature: GZ8MTXP02FTISC.21.38.D05.1.454.CMB.2.raw
  modified_base (200)..(200): a, c, t, g, unknown or other
  misc_feature (200)..(200): n is a, c, g, or t
  modified_base (317)..(317): a, c, t, g, unknown or other
  misc_feature (317)..(317): n is a, c, g, or t
  modified_base (364)..(364): a, c, t, g, unknown or other
  misc_feature (364)..(364): n is a, c, g, or t
tcagtcgtcgctcgcacgaccggtgctcgatttagtatctgatagttgggtttgggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcccttaggtaaccaaacaaaaccgtggccaaggcctcccagtcctcctcatctagtgggctatcctaacgnggatcgaccggcactcccagacgaggttcagtgcctaggtcggtcgngggacagtacttccgactccgcaactactaccaaacgtaccaacgtgaccgtccctaggtaaacgttattttggacctaggttagttaattactagtatagtagttagtacgttggttacgtacgtacccgttaacgtccgtttacgggaccgtaacgggggtaaccaaggggtagaacggtaacgtaccggaaagtaacccggtaactgggttacgggccttacggaccctaaaccgttcgttacgttacgttccttaccgtacctttcccgttacccg

SEQ ID NO: 324370 - DNA, 568 bp, Homo sapiens
  misc_feature: GZ8MTXP02FMU8U.21.38.D05.1.454.CMB.2.raw
  modified_base (204)..(204): a, c, t, g, unknown or other
  misc_feature (204)..(204): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
  modified_base (421)..(421): a, c, t, g, unknown or other
  misc_feature (421)..(421): n is a, c, g, or t
  modified_base (442)..(442): a, c, t, g, unknown or other
  misc_feature (442)..(442): n is a, c, g, or t
tcagtcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttgcatcgacgttgcctaggtaaccaaacaaaaccgtgccagcctccagtctcctcatctagtgggctatctacgagatgaccgcacgtcccagacgtagtcagtcgcgaggtcgggtcnggggacaggtacctcnctcactacatacaacnctacgtgccactagaacttagtttcgactagttnttaacttactagtactaagtnttaggtacgtggtacgtacctacgtacctagtttcggacgtaacggggactagggtagatacgtacagaaaccgagttggacggtctagaccaacgtactcgttcgtacctcgtaccttcgtaccc

SEQ ID NO: 324371 - DNA, 609 bp, Homo sapiens
  misc_feature: GZ8MTXP02JDDDR.21.38.D05.1.454.CMB.2.raw
  modified_base (201)..(201): a, c, t, g, unknown or other
  misc_feature (201)..(201): n is a, c, g, or t
  modified_base (335)..(335): a, c, t, g, unknown or other
  misc_feature (335)..(335): n is a, c, g, or t
  modified_base (388)..(388): a, c, t, g, unknown or other
  misc_feature (388)..(388): n is a, c, g, or t
tcagtcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctcaggcaccctgtctctgtctccgaggggaaangttactctctcctgcaaggccagtcagagtgttggcatcgacgttgcctaggtaacccaaacaaaaaccgtggaccaggcctacccagtcctcctcactctagtcggggctactcctagaggatacggaccggnactcccgagacgtacggttcagtgccaggtcgggtcgtgggacagtaccttcnctctacacactcaacacacgtcgctccgagtaagtctttgactagttagttacttactcgtactagtacgttggtacgttagggtacgtacctaaccgtacgtaccgtttacggaccggttaagggaccgtaagggtagagacgttacgaaggtaaccggtaaacgtggtacggtacctacgacgaaccgtatcgtacgttctactacttaccgttccccg

SEQ ID NO: 324372 - DNA, 562 bp, Homo sapiens
  misc_feature: GZ8MTXP02GC3QZ.21.38.D05.1.454.CMB.2.raw
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (393)..(393): a, c, t, g, unknown or other
  misc_feature (393)..(393): n is a, c, g, or t
tcagtcgtcgctcgcacgaccggtgctcgatttagtatctgatagttgggtttgggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttacnctctcctgcaaggccagtcagagtgttggcatcgacgttgcctggtaccacaaaaactggccaggctccagtctcctcatctatggggcatcctacaggactgaccggcatccccagacaggttcagtgccagtggtctgggacagactttcgactctcgaccagtacaacacactggcgcctgaanttttagctagtgtatactgtcaggatgtatggtagtctacggtacaccgtttaggcccgtaagggaccaagggttgacgtacgtaccgagaacggaaaccttggttacggacgttacggacgaacccgtaatcccgttaggtacctttcgaactttcctttaacccccg

SEQ ID NO: 324373 - DNA, 639 bp, Homo sapiens
  misc_feature: GZ8MTXP01DYBA3.2.53.E09.1.454.CMB.2.raw
  modified_base (320)..(320): a, c, t, g, unknown or other
  misc_feature (320)..(320): n is a, c, g, or t
tcagacgctcgacacacgaccggtgctcgatttagagagagtgtgttgggtttgggccctagatcacagctcctcaccatggactggacctggagcatccttttcttggtggcagcagcaacaggtgcccacgcccaggttcaattggtgcagtctggaactgaggtgaagaagccgtggggccttagtgaaggtctcctgcaaggcttctggttacattctttagcgactatggtatcagcgtgggtgcgacacggcccctggacaaggctgagtggatgggatggatcagtgacttaacaacggtaacaacaaaactntgacaacgagtaacgttccgagggcagacgtcatcctagacccaaacagaacacactacccaacgagacacaacgttacccaaaccgtcggacctaggacggaacgtcccgtagaccaattccgacgaccgaacgaaccgggtccggttagtttaatttaagttgtaggcggaaggacggggaaacgggggagggggggtacgacgggtaccgttccgttttaaggacgttacgggtcgggggttaccgaacggggtaacccgttgggttccttacccggtcctcctccgtcgcccttaccgtaaccgaacgggtcccg

SEQ ID NO: 324374 - DNA, 551 bp, Homo sapiens
  misc_feature: GZ8MTXP01ER7PW.2.53.E09.1.454.CMB.2.raw
  modified_base (402)..(402): a, c, t, g, unknown or other
  misc_feature (402)..(402): n is a, c, g, or t
tcagacgctcgacacacgaccggtgctcgatttagagagagtgtgttgggtttggggccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgactatggtatcagctggggtgcgacaggcccctggacaagggcttgagtggatgggatggatcagtgcttacaacggtaacacaaactatgcacagaagttccagggcagacgtcaccctgacccaacagcacatccacgagcacagtacaactggactgagagcctgacatcngacgacgacggcggtgtattagtgtgcgaggagggacgggaggggggggagcggacgtcgtttggacgttacggtcggggccgacggggtaacccttcgggttccacccggtctccctcgacgcccgttccgaacccgaacgggccccg

SEQ ID NO: 324375 - DNA, 547 bp, Homo sapiens
  misc_feature: GZ8MTXP01AHFN6.2.53.E09.1.454.CMB.2.raw
  modified_base (354)..(354): a, c, t, g, unknown or other
  misc_feature (354)..(354): n is a, c, g, or t
  modified_base (452)..(452): a, c, t, g, unknown or other
  misc_feature (452)..(452): n is a, c, g, or t
tcagacgctcgacacacgaccggtgctcgatttagagagagtgtgttgggtttgggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgacttacaacggtaacacaaactatgacacagaagttccagggcagagtcaccctgaccaanagcacatccacgagcacagtacaaccgtggacctgagagcctgacatcagacgacgacggcggtgtattagttgtgcgaggagggacgggaggggggnacggacgtccgtttgacgttacggtcggggccgacgggtaacccgttggttccaccgtcgtcctcgacgcccgttaccgaaccgaacgggtcccg

SEQ ID NO: 324376 - DNA, 543 bp, Homo sapiens
  misc_feature: GZ8MTXP01EQP95.2.53.E09.1.454.CMB.2.raw
  modified_base (248)..(248): a, c, t, g, unknown or other
  misc_feature (248)..(248): n is a, c, g, or t
  modified_base (372)..(372): a, c, t, g, unknown or other
  misc_feature (372)..(372): n is a, c, g, or t
tcagacgctcgacacacgaccggtgctcgatttagagagagtgtgttgggtttggggccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctggggtncgacaggcccctggacaagggcttgagtggatgggatggatcagtgcttacaacggtaacacaaactatgcacagaagttccagggcagagtcaccctgacccaacagaacacatccacgagcncagtcaactggacctgaggagcctgacatctgacgacacggccggtgtattattgtgcgaggagggacgggaggggggagcggacgtcgtttggacttacggtggggccgacggggaacccttgggttcacccggtctcctcgacggcccttaccgaaccgaacgggcccc

SEQ ID NO: 324377 - DNA, 745 bp, Homo sapiens
  misc_feature: GZ8MTXP01DG45G.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgactatggtatcagcgtggggtgcgacgacggcccctaggacaagggcttggagtggatgggatggatcgagtgacttaacgaaacggtaaacaacaaaactatgacaacgaggtaacgttccgaggggacaacggacgtaccaacccgtagaacccaaacaacgaaccaacaacgtacccaacggacgacaaacgtaacgtaccaaacccgtacggaacccgtaggaacggacgtacccgtaggactaacgtaccgtacggaaccgaaccgtaacccgggtaccggttaggtttaacgttttaacgttggtacggaccgggaaggggaacgggggaaaccgggggagggggggggtaacgaccggtaccggttcccgttttaagggaaccgttacggggtacgggggacccgtaaacgggggtaaccccgttcgggttcccgttaacccggttcccgttacccgtccgacccggtaccccgttaccccgtaacccgggaacccggggtaacccccg

SEQ ID NO: 324378 - DNA, 672 bp, Homo sapiens
  misc_feature: GZ8MTXP01BFSKV.2.53.E09.1.454.CMB.2.raw
  modified_base (364)..(364): a, c, t, g, unknown or other
  misc_feature (364)..(364): n is a, c, g, or t
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgactatggtatcagctggggtgcgacacggcccctggacaagggcttggagtggatgggatggatcgagtgcttaacaacggtaacacaaactatgacacagaacgttccgagggcagacgtcaccctgacccaanacgaacacactcccaacgacgacaacacgtaccaaccgtacgggaaccctgggaacgggacgacccgttacggaacctaacgttccgtacgaaccggtaaccgaaccggggtacccggtttaggtttaacgtttaagttcggtaggaccgggaagggacgggggaacgggggagggggggggtacgaccgggtacggttcccgtttaaggaccgttacgggtcggggaccgacggggtacccgttacgggttccgttacccggtcctcccgtcgaccgcccgttacccgaaccgttaacgggtccccg

SEQ ID NO: 324379 - DNA, 657 bp, Homo sapiens
  misc_feature: GZ8MTXP01BHLZY.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctgggcctcagtgaaggtctctgcaaggcttctggttacatctttagcgtactatggtatcagctgggtgcgacacggccctggacagggcttggagtggatgggatggatcgagtcgacttaacgaaacggtaacaactaaactatacgcaacgagtaacgttccgagggcaagacgtccaccctagaacccaaacacgaaccacactacccgaacgacgacaaacgacgtaccaaccgtacggaccgtaggaacggtacgaccgtagacctacgtacgtacgaaccgacgtaccgggtaccggttagtttatttagttcggtaggaccggaagggacggggaacgggggagggggggacgaccggtacggttccgtttaacggacgttacgggtcggggaccgtacggggtaacccgttgggttccgttacccgtcctacccgtcgaccgcccttacccgaaccgaaccgggtccccg

SEQ ID NO: 324380 - DNA, 621 bp, Homo sapiens
  misc_feature: GZ8MTXP01B5J0F.2.53.E09.1.454.CMB.2.raw
  modified_base (585)..(585): a, c, t, g, unknown or other
  misc_feature (585)..(585): n is a, c, g, or t
tcagacgctcgacacacgaccggtgctcgatttagagagagtgtgttgggtttgggccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgactatggtatcagctgggtgcgacacggcccctggacaagggcttgagtggatgggatggatcagtgacttaacgaacggtaaacacaaactagtagacacaagaacgttccgaggggcaacggacgtacaccctagaaccaaacagaaccacactcccaacgacgcaacacgtaccaaaccgtacggacccgtaggaacggacgaccgtacgactactcgacgaacgacgaccgggtccggtagttattacgttgtagcggtagggacgggacggggaggggggacgtcggacggttcgttttcggaaccgttcggtcggggaccgaacgggtacccgttcggttccaccggttccncccgtcaccgcccttaccgaacccgaacggtccccg

SEQ ID NO: 324381 - DNA, 716 bp, Homo sapiens
  misc_feature: GZ8MTXP01B4C6B.2.53.E09.1.454.CMB.2.raw
  modified_base (250)..(250): a, c, t, g, unknown or other
  misc_feature (250)..(250): n is a, c, g, or t
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgactatggtatcagctggggtncgacacggcccctggacgaagggcttgagtggagtgggatggatcagtgacttaacgaacggtaacaactaaactatcgacaacgagtaacgttccgaggggcaagacgtaccacccgtagaacccaacgacgaaccacactcccgaacgacgtcaaacgtacgtaccaaccgtcggaacccgtggacggacgtaccgtagactacgtcgtacgaacccgaacgtacccgggtccggtttagttaagtttagttcgggtacgacggaaggggaacggggaaccggggggaggggggggaccgtaccggggtaccggttaccggttttaaggaacccggttacggggtaccgggggacccgtaaaccgggggtaaccccgttcggggttacccgttaccccggttccgttaccccgtcgtacccggtcccccgttacccgaaaccccgggttaacccgggtcccccg

SEQ ID NO: 324382 - DNA, 790 bp, Homo sapiens
  misc_feature: GZ8MTXP01COG2X.2.53.E09.1.454.CMB.2.raw
tcagacgctcgacacacgaccggtgctcgatttagagagagtgtgttgggtttgggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgactatggtatcagctgggtgcgacacggccctggacaagggcttgagtggatgggatggatcgaggtgactttaacgaacggtaacaacaaaactatgacaacagaagttccgagggcaacgacgtcaccctagacccaacacgaacacactcccaacgacgacaacacgtaccaaacccgtacgggaacctacgggaacgggtacgacccgttacggaacgtaacgtaccgttacgaacccggaaccgtaacccggggtacccggggtttagggtttaaacgttttaacggttttagggttacgggtaccggggaaggggaaacggggggaaacccgggggggaaggggggggggggtaaccggggtaacccgggggtaacccggggtttcccggtttttaacgggggtaacccggttaaccgggggttaccggggggaccccgggtaaacgggggtaacccccgttcgggggttaccccgttaccccgggttcccgttccccgttaaccgaacccggtccccggttacccgtaaaccccggaaccgggggtaaccccccg

SEQ ID NO: 324383 - DNA, 620 bp, Homo sapiens
  misc_feature: GZ8MTXP01CPSYF.2.53.E09.1.454.CMB.2.raw
  modified_base (188)..(188): a, c, t, g, unknown or other
  misc_feature (188)..(188): n is a, c, g, or t
  modified_base (326)..(326): a, c, t, g, unknown or other
  misc_feature (326)..(326): n is a, c, g, or t
  modified_base (516)..(516): a, c, t, g, unknown or other
  misc_feature (516)..(516): n is a, c, g, or t
tcagacgctcgacacacgaccggtgctcgatttagagagagtgtgttgggtttggggcccctagatcacagctcctcaccatggactggacctggagcatcctttttcttggtggcagcagcaacaggtgcccacgcccaggttcaattggtgcagtctggaactgaggtgaagaagcctggggcctnagtgaaggtctcctgcaaggcttctggttacattctttagcgactatggtatcagctggggtgcgacgacggccctggacaagggcttggagtggatgggatggatcgagtgactttaacgaacggtaacacaaactntagacaacgagaacgttccgagggcacgacgtcacctagaccaaacaagaacacactacccgaacgacgacaacgacgtaccaaccgtcggacctaggacgacgaccgtagactagtcgacgaacgacgaccggtcggttagttagtttagtaggtacgacggagggacgggacgggggaggggggtacncgggtacgttcgtttaacggacgttacgggcggggaccgacgggtaaccgttcgggttccacccgtccgtcctcgaccgtcccttaccgaaccgaacgggtccc

SEQ ID NO: 324384 - DNA, 681 bp, Homo sapiens
  misc_feature: GZ8MTXP01DCIDE.2.53.E09.1.454.CMB.2.raw
  modified_base (215)..(215): a, c, t, g, unknown or other
  misc_feature (215)..(215): n is a, c, g, or t
  modified_base (332)..(332): a, c, t, g, unknown or other
  misc_feature (332)..(332): n is a, c, g, or t
tcagacgctcgacacacgaccggtgctcgatttagagagagtgtgttgggtttggggcccctagatcacagctcctcaccatggactggacctggagcatcctttttcttggtggcagcagcaacaggtgcccacgcccaggtttcaattggtgcagtctggaactgaggtgaagaagccgtggggcctgagtgaaggtctcctgcaaggtcttntggttacattctttagcgatatggtatcgagctggggtgcgacgacggccctggaacgaagggcttgaggttggatgggatggatcagtgacttacgaaacggtaacaacaaaactntcgacaacgaagtaacgttccgaggggaccaagtacggaccaaccgtacgaacccaaacaacgaaccaacaaacgtacccgaacgacgaccaacgaccggtacccaaaccgttcggaacccgtggaacgggaacacgttacgaacacgtacgacgaaccgaacgaaccggttccgggttaagtttacgtttaagttgggtaggacggaagggaggggaacgggggaggggggacgccggtaaccgtccgttttaacggacgttacgggtcggggacccgtaacggggaacccttcgggttcccaccggttcctccgtaacgcgtaccccacgtaacccgaacggtcccg

SEQ ID NO: 324385 - DNA, 564 bp, Homo sapiens
  misc_feature: GZ8MTXP01C6ZXE.2.53.E09.1.454.CMB.2.raw
  modified_base (186)..(186): a, c, t, g, unknown or other
  misc_feature (186)..(186): n is a, c, g, or t
  modified_base (247)..(247): a, c, t, g, unknown or other
  misc_feature (247)..(247): n is a, c, g, or t
tcagacgctcgacacacgaccggtgctcgatttagagagagtgtgttgggtttggggccctagatcacagctcctcaccatggactggacctggagcatccttttcttggtggcagcagcaacaggtgcccacgcccaggttcaattggtgcagtctggaactgaggtgaagaagcctggggcctnagtgaaggtctcctgcaaggcttctggttacatctttagcgactatggtatcagctgggtncgacaggccctggacaagggcttgagtgatgggatggatcagtgacttacaacggtaacacaaactatgacacagaagttccgagggtcagacgtacacccgtcgaccaaacagaacacaactcccaacgacgacacagtaccaacctcggactgacggagacctgactactctagacgacgacggtccggtagtacttatgtagcgagagggacgggaggggggacgcggacgtcgtttgacgttacgtcggggccgaagggacccttcgggttcaccgtcctcctcacgccgttaccaaccgttaacggaacccg

SEQ ID NO: 324386 - DNA, 624 bp, Homo sapiens
  misc_feature: GZ8MTXP01ERFZ2.2.53.E09.1.454.CMB.2.raw
  modified_base (249)..(249): a, c, t, g, unknown or other
  misc_feature (249)..(249): n is a, c, g, or t
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgactatggtatcagctgggtncgacaggcccctggacagggcttgagtggatgggatggatcgagtgcttaacgaacggtaacaacaaactatacgacacagtaacgttccgaggggcacggacgtaccaccctgaacccaacagaacacaactcccaacgacgacacacgtaccaacctggacctagacggagcctgactatcgtacgacgacgaccgggccggtagttagttagttggtggcggaggagggaacggggagggggggacgcggtacgtccgtttaaggacgttacggtcgggggaccgacggggtaacccgttcgggttccgttacccggttcctcccgtaaccgaccggtaccccttacccgaacccgttaacgggtaaccccg

SEQ ID NO: 324387 - DNA, 628 bp, Homo sapiens
  misc_feature: GZ8MTXP01EDHB2.2.53.E09.1.454.CMB.2.raw
  modified_base (211)..(211): a, c, t, g, unknown or other
  misc_feature (211)..(211): n is a, c, g, or t
  modified_base (380)..(380): a, c, t, g, unknown or other
  misc_feature (380)..(380): n is a, c, g, or t
tcagacgctcgacacacgaccggtgctcgatttagagagagtgtgttgggtttggggccctagatcacagctcctcaccatggactggacctggagcatcctttttcttggtggcagcagcaacaggtgcccacgcccaggttcaattggtgcagtctggaactgaggtgaagaagccgtggggcctcagtgaaggtctctgcaaggcttntggttacattctttagcgtaactatggtactcgagtcgtggggtcgacgacgacggcccgtaggaacgaagggtcttaggagtggagtgggatggatcgagtcgacttaacgaacgtaacaacgaaactagcgacacgagtacgtcgaggcagactacacctgaccaanacgaacacacaccgacgacgacactacgtacaacgtcggaaccgtggacgacgtaccagtaactcgtacacgaccgtacgaccgttacggtagttattagtggtacggacggaggaggggacggggagggggtacgccggtacgttcggtttaagacggttacggtacgggaccgacgggtaacccttgttacccgacccgttctaccctcgaccccgtccgacccgtaaccggaaccggtaaccccg

SEQ ID NO: 324388 - DNA, 728 bp, Homo sapiens
  misc_feature: GZ8MTXP01AWWWQ.2.53.E09.1.454.CMB.2.raw
  modified_base (332)..(332): a, c, t, g, unknown or other
  misc_feature (332)..(332): n is a, c, g, or t
tcagacgctcgacacacgaccggtgctcgatttagagagagtgtgttgggtttgggcccctagatcacagctcctcaccatggactggacctggagcatccttttcttggtggcagcagcaacaggtgcccacgcccaggttcaattggtgcagtctggaactgaggtgaagaagccgtgggcctcagtgaaggtctcctgcaaggcttctggttacattctttagcgtactatggtatcagcgttgggtgcgacgacggcccctggaacgaagggcttggaggtggagtgggatggatcgagtgacttaacgaacggtaacaactaaactntcgacacgagtaacgtccgagggcaacgtacgtccacccgtgaacccaaacacgaaccaacactacccgaacgacgacaaacgtacgtaccaaccgtaggacccgtaggaacggacgaccgtagaactacgtaccgtacgaaaccggtaaccgtaaccgggtccggttaaggtttaacttaacggttgggtacggaaccggaagggggaacgggggtaaaccgggggaaggggggggtactaccgggttaccggttaccggtttaacgggaaccgttaaccgggggtccggggaacccggtaaaccgggggtaaccccttcggggttcccaaccccggttcccgtacccgtccgaaccgtccccgttacccggaacccgttaaaccggggtccccg

SEQ ID NO: 324389 - DNA, 744 bp, Homo sapiens
  misc_feature: GZ8MTXP01CQQXG.2.53.E09.1.454.CMB.2.raw
tcagacgctcgacacacgaccggtgctcgatttagagagagtgtgttgggtttgggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgtacttagtggtatcagcgtggggtgcgacgacggcccctggacaagggcttaggaggtggagtgggatggatcgagtgtactttaacgaaacggttaacaactaaactatacgacaacgaagtaacgttccgaaggggtcaacggaccggtaccaccgtacgaacccaaacgaacgaacctaacactacccaacggacgaccaacgacgtaccaaccgtcggaaccgtggacggacgaccttacggaactacgtcgtacggaacccgacggtacccgggttccggtttaagttaacgttttagtaggtacggacgggaaggggaacgggggaaccggggggaggggggtacgtccgggtaaccggttccggttttaacgggaacggttaccgggttacgggggacccggtaaaccgggggtaccccgttacgggttaccccgttacccggttcccgtcccgttccgaacccggtccccgttaccccgtaaacccgggttaacccgggtaacccccg

SEQ ID NO: 324390 - DNA, 684 bp, Homo sapiens
  misc_feature: GZ8MTXP01B94Z4.2.53.E09.1.454.CMB.2.raw
tcagacgctcgacacacgaccggtgctcgatttagagagagtgtgttgggtttggggcccctagatcacagctcctcaccatggactggacctggagcatcctttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacgacggccctggacaagggcttggagtggagtgggatggatcgagtgtactaacgaacggtaaacaactaaacgttatcgacaacgaagtaacgttaccgaaggggcaacggacggttaccaacccgtacgaacccaaacaacgaacaacaactaccgaacgaagaccaacgaacgtacctaaaccgtacggaaccgtacggaacggaacgaccgtacggaactacgttcgacggaacgaaccgaccgggtaccgggttagttaagtttaacgttcggtagacggaaggacgggggaacggggacggggggggacgaccggtacggtccgttttaacggacgttacgggtcggggttaccgaacggggtaacccgttcggttccacccgtcctcctcgtacgcccgttaccgaacccgaacgggtaaccccg

SEQ ID NO: 324391 - DNA, 564 bp, Homo sapiens
  misc_feature: GZ8MTXP02G6PN3.2.53.E09.1.454.CMB.2.raw
  modified_base (250)..(250): a, c, t, g, unknown or other
  misc_feature (250)..(250): n is a, c, g, or t
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagccgtggggccttagtgaaggtctcctgcaaggcttctggttacattctttagcgactatggtatcagctgggtncgacacggcccctggacaagggcttgagtggatgggatggatcagtgcttacaacggtaacacaaaactatgcacagaagttccgagggcagacgtcatcctagaccacagacacataccacgacgacacacgtaccaaacctacggaccctaggaggagcctagacatcgacgacgaacgaccgggtccgtagttattagttggtgacgaggagggacgggaggggggagacggacgtcgttttacgacgtacggtcggggaccgacgggaccgtcggtcaccgtcgtcctcacgcctaccaccgaacggccc

SEQ ID NO: 324392 - DNA, 520 bp, Homo sapiens
  misc_feature: GZ8MTXP02H2BHV.2.53.E09.1.454.CMB.2.raw
  modified_base (248)..(248): a, c, t, g, unknown or other
  misc_feature (248)..(248): n is a, c, g, or t
tcagacgctcgacacacgaccggtgctcgatttagagagagtgtgttgggtttggggccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctggggtncgacaggcccctggacaagggcttgagtggatgggatggatcagtgcttacaacggtaacacaaaactatgcacagaagttccagggcagagtcacctgaccacagcacatccagagcacagtacaacctggacctgaggagcctgacatctgacgacacggccgtgtattatgtgcgagaggacgggaggggggagcggacgccgtttagacgtacgtcgggccgacgggacccgtggtcaccgtctcctcacgcctccaccgaacggccc

SEQ ID NO: 324393 - DNA, 543 bp, Homo sapiens
  misc_feature: GZ8MTXP02HJ13G.2.53.E09.1.454.CMB.2.raw
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
  modified_base (367)..(367): a, c, t, g, unknown or other
  misc_feature (367)..(367): n is a, c, g, or t
tcagacgctcgacacacgaccggtgctcgatttagagagagtgtgttgggtttgggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgcttacaacggtaanacaaaactntgcacagaagttccagggcagagtcaccctgaccacagacacatccacgancacagtacaacctggaccctgaggacgccgtagacatctagacgacgacggccgtagttattattgtgcgagagggacgggaggggggagcggacgtccgtttagacgtacgtcggggaccgacgggtacccgtggtccaccggtcctccgtcacggcctaccgaccgaacggccc

SEQ ID NO: 324394 - DNA, 551 bp, Homo sapiens
  misc_feature: GZ8MTXP02I8M67.2.53.E09.1.454.CMB.2.raw
  modified_base (455)..(455): a, c, t, g, unknown or other
  misc_feature (455)..(455): n is a, c, g, or t
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctggggtgcgacaggcccctggacaagggcttgagtggatgggatggatcagtgctttacgaacggtaacacaaactatgcacagaagttccaggggcagagtccacctgaccacagacacactccacgagcacagtacaactggacctgaggagctgacatctagacgacgacggcgtacgtattattgtgcgaggagggacgggaggggggngacggacgtcgtttacggacgtacgtcggggaccgacgggacccgtcggtccgaccgtccgtcctccgacgcccgtacccaccgacgggtaccccg

SEQ ID NO: 324395 - DNA, 558 bp, Homo sapiens
  misc_feature: GZ8MTXP02HT7KA.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctggggtgcgacaggcccctggacaagggcttgagtggatgggatggatcagtgcttacaaacggtaacacaaaactatgacacagaacgttccaagggcagagtccacctgaccacagacacactccacgagcacagtacaaacctggacctgaggacgctagacatctacgacgacgacggaccgtgttattattgtagacgaggagggacgggaggggggagacggacgtcgtttacggacgtacgtcggggaccgacgggacccgtacggtccaccggtctccgtacacgccctaccgaccgtaacggacccg

SEQ ID NO: 324396 - DNA, 741 bp, Homo sapiens
  misc_feature: GZ8MTXP02G6GGA.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcgagtgcttaacgaaacggtaacaactaaaactatgacaacagtaaacgttccgaaggggcaaggacgtccaccctcgaaccacaacgaccaacactaccaacgacgaccaacaacgtaccaaaccgtacggaacccgtagggaacgggacgacccgtacggaacctaacgttaccgtacggaaccggaaacccgaacccggggtacccggtttaagggtttaatttaacgtttgggtacggtaccgggaaaggggaacgggggaaccggggggtaaagggggggggggaaccggaccgggggtaacccgggttacccggtttttacgggaacccggtttaacgggtccggggggtaacccggaaaccgggggtaaaccccggttcgggtacccgtacccgtccgtacccgtccgaccgtcccgtacccgaacccgaaccggggtacccccg

SEQ ID NO: 324397 - DNA, 553 bp, Homo sapiens
  misc_feature: GZ8MTXP02HGYFL.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctggggtgcgacaggcccctggacaagggcttgagtggatgggatggatcgagtgcttacaacggtaacacaaaactatgacacagaacgttccgagggcagagtccaccctgaccacagacacactccacgagacacagtcaaccgtcggacctgaggagcctgacatctagacgacgacggtccgtgttattagttgtgacgagagggacgggaggggggagcggacgtcgtttacgacgtacgtcggggcgaacgggaaccgtcggtacgaccgtctaccgtcgacgtccctaccgaccgaacggcccg

SEQ ID NO: 324398 - DNA, 674 bp, Homo sapiens
  misc_feature: GZ8MTXP02HEQ3X.2.53.E09.1.454.CMB.2.raw
  modified_base (248)..(248): a, c, t, g, unknown or other
  misc_feature (248)..(248): n is a, c, g, or t
  modified_base (291)..(291): a, c, t, g, unknown or other
  misc_feature (291)..(291): n is a, c, g, or t
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtncgacaggcccctggacaagggcttggagtggatgggatggatnagtgacttaacgaacggtaacaacaaaactatacgacaacgaaggtaaacgttccgaaggggacaacggacgtccaacccgtcgaacccaacacgaccaacactacccacgacgacaacaacgtaccaaccgtcggaccctgaaggacgactacgacactacgtacgaacgacgaccgggtaccgttaggttaatttacgttgggtacggaccgggaacgggaaggggaacgggggaagggggggacgtaccgggtaacggttcccgtttttaagggaccgttacgggtccgggggacccgtaacgggggtaacccgttcgggtacccgtaccggtcctacccgtcgaccgtcccgtacccgacccggtaaacggggcccccg

SEQ ID NO: 324399 - DNA, 716 bp, Homo sapiens
  misc_feature: GZ8MTXP02JS1TS.2.53.E09.1.454.CMB.2.raw
  modified_base (250)..(250): a, c, t, g, unknown or other
  misc_feature (250)..(250): n is a, c, g, or t
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgactatggtatcagctggggtncgacaggcccctggacaagggcttgagtggagtgggatggatcagtgacttaacgaaacggtaacaacaaaactatcgacaacagtaacgttccgaggggacacggacgtccaacccgtgaccaacacgaccacactacccgaacgacgaccaaaccgtacgtacccaaacccgttacggaacccgtaggaacgggacgcccgtagaaccacgtccgtacggaaccgaccgaccgggtaccgttagttaagtttacgttcgggttacggacgggtaagggaacgggggaaccgggggagggggggacgaccggggtaaccgttcccgtttttacggaccggttaccgggtacgggggtacccggaaacgggggttaccccgtacggggttacccgtaaccccggttccgttccccgtaccgtacccggtaccccgtaaccccgaacccggaacccgggtacccccg

SEQ ID NO: 324400 - DNA, 545 bp, Homo sapiens
  misc_feature: GZ8MTXP02JU07K.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctggggtgcgacaggcccctggacaagggcttgagtggatgggatggatcagtgcttacaacggtaacacaaactatgcacagaagttccagggcagagtcaccctgaccacagacacatccacgagcaacacgtaccaacctggacctgaggagctgacatctgacgacacggccgtgtacttatgtgcgagagggacggaggggggagcggacgtcgtttcgacgtacgtcggggaccgacgggaacccgtcggtccaccggtcctcccgtacgacggccctacccgaccgaacgggacccg

SEQ ID NO: 324401 - DNA, 652 bp, Homo sapiens
  misc_feature: GZ8MTXP02JMP7H.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgactatggtatcagcgtgggtgcgacacggcccctggacaagggcttgaggtggagtgggatggatcgagtgtacttaacgaaacggtaaacaacaaaactatgacaacgaggaaacgttccgaaggggccaaggacgtaccacccctagaacccacaacgaccaaccactacccgaacgagaccacaacgtaccaaaccgtacggaccgtaggacggacgccgtacgactactcacgaccgacgaccggccgttagttattacgttggtagacggagggacgggggaacggggagggggggacgcggtacgtccgtttacggacgttacgggtcgggggaccggtaaccgggtaacccgtcgggtacctacccggttcgtcccgtacgaccggacccgtacccgaacccggtaaccggacccg

SEQ ID NO: 324402 - DNA, 602 bp, Homo sapiens
  misc_feature: GZ8MTXP02HI8WP.2.53.E09.1.454.CMB.2.raw
  modified_base (322)..(322): a, c, t, g, unknown or other
  misc_feature (322)..(322): n is a, c, g, or t
  modified_base (328)..(328): a, c, t, g, unknown or other
  misc_feature (328)..(328): n is a, c, g, or t
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacacggcccctggacaagggcttggagtggatgggatggatcgagtgacttacgaacggtaacaacaaactntgcaanagaacgttccgagggcagacgtcaccctagaccacagaccacatacccagacgacaacacgtaccaaccgtcggacctggacggacgactagacacgttcgacgaccgacgaccggtccgtagttaagttacgttggtacgacggagggaggggacgggggaggggggacgacggtacgtcgtttacggacgtacggtcggggaccgacgggaacccgtcggtacctacccgtccgtccgtaccgacgtaccctacccgaccgaccggtacccg

SEQ ID NO: 324403 - DNA, 550 bp, Homo sapiens
  misc_feature: GZ8MTXP02GEN5M.2.53.E09.1.454.CMB.2.raw
  modified_base (248)..(248): a, c, t, g, unknown or other
  misc_feature (248)..(248): n is a, c, g, or t
  modified_base (322)..(322): a, c, t, g, unknown or other
  misc_feature (322)..(322): n is a, c, g, or t
tcagacgctcgacacacgaccggtgctcgatttagagagagtgtgttgggtttgggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctggggtncgacaggcccctggacaagggcttgagtggatgggatggatcagtgcttacaacggtaacacaaactatgacanagaagttccaggcagagtcaccctgaccacagcacatccacgacgacaacagtacaacctgacctagacgagctgacatctagacgacacggccgtagtattattgtgacgaggagggacgggaggggggagcgacgtcgtttgacgtacgtcggggccgaacgggacccgtacggtccgaccggtccgtaccgtccgtacgcccgtaccaacccggaacggtacccg

SEQ ID NO: 324404 - DNA, 515 bp, Homo sapiens
  misc_feature: GZ8MTXP02FF51F.2.53.E09.1.454.CMB.2.raw
tcagacgctcgacacacgaccggtgctcgatttagagagagtgtgttgggtttggggcccctagatcacagctcctcaccatggactggacctggagcatcctttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctggggtgcgacaggcccctggacaagggcttgagtggatgggatggatcagtgcttacaacggtaacacaaactatgcacagaagttccagggcagagtcacctgaccacagacacatccacgagcacagtcaacctggacctgaggagcctgacatctagacgacacggccgtgtattatgtgcgagaggacggaggggggagcgacgcctttgactacgtgggccagggaaccctcggcaccgtcgtcctcacgccctccaccgacgggccc

SEQ ID NO: 324405 - DNA, 530 bp, Homo sapiens
  misc_feature: GZ8MTXP02I2V0T.2.53.E09.1.454.CMB.2.raw
tcagacgctcgacacacgaccggtgctcgatttagagagagtgtgttgggtttgggccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctggggtgcgacaggcccctggacaagggcttgagtggatgggatggatcagtgcttacaacggtaacacaaactatgcacagaagttccagggcagagtcacctgaccacagcacatccacgagcacagtacaacctggacctgaggagcctgacatctgacgacacggccgtgtattatgtgcgagaggacgggagggggagacggacgcgtttagacgtacggtcggggccgacgggaacccgtcggtccgaccgtcgtccgtcacgccgtaccaccgaacggacccg

SEQ ID NO: 324406 - DNA, 709 bp, Homo sapiens
  misc_feature: GZ8MTXP02HT5S1.2.53.E09.1.454.CMB.2.raw
tcagacgctcgacacacgaccggtgctcgatttagagagagtgtgttgggtttgggcccctagatcacagctcctcaccatggactggacctggagcatccttttcttggtggcagcagcaacaggtgcccacgcccaggttcaattggtgcagtctggaactgaggtgaagagccgtgggcctcagtgaaggtctcctgcaggcttctggttacatcttagcgtactatggtatcagcgtgggtgcgacgacggcccctaggacaagggtcttggaggtggagtgggatggatcgagtcgtacttaacgaaacggtaaacaactaaaacgtatacgacaacgtaagtaaacgttaccgaggggacacgacgtacccacccgtagaaccaacgagaccaactaacaccgaacgacgaccaacacgtaccaacgtcggaccgtaggaacgcgacctacgactacgtacgacgaaccgtaccggtaccgggttaccgtttagtttaagttagttacgggacggacgggaaaggggacgggggaaccgggggtaggggggaacgtccgggttaacccggttcggttttacggaaccggtttacggggtaccggggaaccggtaaaccgggttacccggtcggtaacccgtcccgttaacccgttaccgaccggtacccgaccccgtacccgaacccggtacccggtaccccg

SEQ ID NO: 324407 - DNA, 566 bp, Homo sapiens
  misc_feature: GZ8MTXP02JQ4IJ.2.53.E09.1.454.CMB.2.raw
  modified_base (249)..(249): a, c, t, g, unknown or other
  misc_feature (249)..(249): n is a, c, g, or t
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctggggtncgacaggcccctggacaagggcttgagtggatgggatggatcagtgcttacaacggtaacacaaactatgacacagaagttccagggcagagtcaccctgaccacagaccacactccacgagcacagtacaaccgtggacctgaggagcctagacactctacgacgacgaccggtccgtagttattagttggtagacggaggagggacggggagggggggagacggacgtcgtttacggacgtacggtcggggaccgacggggtacccgtacggtccaccggtccgtccgtacacgcctacccgaccgacggacccg

SEQ ID NO: 324408 - DNA, 648 bp, Homo sapiens
  misc_feature: GZ8MTXP02HHY9Z.2.53.E09.1.454.CMB.2.raw
  modified_base (311)..(311): a, c, t, g, unknown or other
  misc_feature (311)..(311): n is a, c, g, or t
  modified_base (404)..(404): a, c, t, g, unknown or other
  misc_feature (404)..(404): n is a, c, g, or t
tcagacgctcgacacacgaccggtgctcgatttagagagagtgtgttgggtttgggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgacttaacgaaacggtaanaacaaaactatgacaacgaagtaaagtccaagggacagacgtaccacctgaacacagacaacactaccaacgagacaactaagtaccaaaccncggaacccgtaggagacgccctagaacacgtctagaacgaacgtaccggaccgttaggttaattaagttggtaggtacggaagggaaggggaacggggaaggggggggacgaccggtaaccggtacccgttttaggaaccggtttaacggtaccgggggacccgaaacggggtaacccgtcggttacccgaaccggttcctcccgtacgacggtacccctacccgaaaccgaaacggtaccccg

SEQ ID NO: 324409 - DNA, 657 bp, Homo sapiens
  misc_feature: GZ8MTXP02IBBB8.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgactatggtatcagctgggtgcgacaggcccctggacaagggctgagtggatgggatggatcagtgacttaacgaaacggtaaacactaaaactatgacaacaaggaaacgttccgaaggggcaacgacgtaccaccctagaaccacaagacaacatcccgaaagacgacaacacgtaccaaaccgtacggaccgtggacggacgccgtagactatacgtcgacgaccgaccggccgttagttatttacgttggtacgacggaagggacggggacgggggagggggggacggaccgggtaaccggtccgttttacggacgttacgggtacgggacccggtaacggggtaaccccgttcgggtacccgtacccggtcccgtcccgtaccgtaccgtccccgtacccgaacccggtaaccgggtacccccg

SEQ ID NO: 324410 - DNA, 605 bp, Homo sapiens
  misc_feature: GZ8MTXP02HQF5R.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggtcttggagtggagtgggatggatcgagtgtacttaacgaacggtaaacacaaaactatgacacagaacgttccgagggtcagactaccacctgacacagacacactccacgagacacacgtaccaacgtcggacctaggacggacgcccgtagactaactcgacgaccgacgacggtccgttagttagttagttggtgacggaggagggacggggaggggggacgacggtacgttcccgtttaggaccggttacgggtcggggaccgtaacgggtaacccgtcggtcccgtaccgtccgtaccgtacgaccgccctaccggaccgaacggtccccg

SEQ ID NO: 324411 - DNA, 749 bp, Homo sapiens
  misc_feature: GZ8MTXP02I00RB.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagccgtgggcctcagtgaaggtctcctgcaaggcttctggttacattctttagcgtactatggtatcagtcgtggggtgcgacacggcccctggacaagggcttggagtggagtgggatggatcgagtgactttaacgaaacggtaaacaacgtaaaactatacgacaacgaagtaaacgttccgaaaggggacaacggacgtacccaacccgtacgaacccaacgaacgaccaacacacccaacgagaccaaacacgtaaccaaaccgtacggaacccgtaggaacggacgaccgtacgaactacgttaccgacgaaccggaaccgtaccgggtaccgttaaggtttagtttaacggtttagggtacggtacgggaaggggaacgggggaacgggggaaggggggggacgtaccggggtaaccgttccggtttttacggaaccggtttaccgggtaccgggggaacccggtaaccgggggtaaccccgtacgggttacccgtaacccggttccgtaccccggtacccgtacccgacccccgtaaccccgaaacccgggtaaccgggtacccccg

SEQ ID NO: 324412 - DNA, 690 bp, Homo sapiens
  misc_feature: GZ8MTXP02GSSNB.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgactatggtatcagctgggtgcgacacggcccctggacagggcttgagtggatgggatggatcgagtgcttaacgaacggtaacacaaaactatgacacgagaaacgtccaagggcaggactccaccgtgaccacagaccacactccgaacgagcaacgacgtccaaaccgtcggaaccctaggaacggacgacctacggaactacttaccgacgaaccggaccgaaacccgggtccggttaggtttaactttaacgttgggttaggaccgggtaaacgggaagggggaaccgggggaaaggggggggaccgaccggggtaaaccgggttcccgtttttacgggaaccgttacggggttaccgggggtaccggaaccggggtaaacccgttcggggtacccgtacccgggttccgtacccgtaccgaccggtaccctacccgaacccggaaaccggtccccg

SEQ ID NO: 324413 - DNA, 561 bp, Homo sapiens
  misc_feature: GZ8MTXP02I70UP.2.53.E09.1.454.CMB.2.raw
  modified_base (291)..(291): a, c, t, g, unknown or other
  misc_feature (291)..(291): n is a, c, g, or t
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctggggtgcgacaggcccctggacaagggcttgagtggatgggatggatnagtgctttacaaacggtaacacaaactatagcacagaacgttccagggcagagtccaccctgaccacagcacactccaacgagacacagtacaacctggacctgaggagcctagacatcagacgacacggccgtagtattattggtgcgagaggacggggaggggggagcggacgtccgtttagacgttacgtcggggaccgacggggtaaccctcgggtcctaccggtccgtacccgtcgacgcccgtacccgacccgaacggaccccg

SEQ ID NO: 324414 - DNA, 630 bp, Homo sapiens
  misc_feature: GZ8MTXP02JGSP1.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagcgtggggtgcgacacggcccctggacagggcttgagtggatgggatggatcagtgacttacgaacggtaacacaaactatgacacaagtaacgttccaaggggcagacgtaccaccctagacccaacagaccacactcccaacgagcaacagtaccaaaccgtcggacctggacggacgcctgacatcgtacgacgaccgaccgggtccgtagttaacgtttagttggtaggacggaagggaacgggggacgggggaaggggggggagaccgggtacggtccgttttacgggacgttacggtcgggggacccgacgggggtaaccccttcgggtcccaccggttccgtcccgtacgacgacccgtacccgaaccggaaccgggtccccg

SEQ ID NO: 324415 - DNA, 586 bp, Homo sapiens
  misc_feature: GZ8MTXP02HVA8Y.2.53.E09.1.454.CMB.2.raw
  modified_base (361)..(361): a, c, t, g, unknown or other
  misc_feature (361)..(361): n is a, c, g, or t
tcagacgctcgacacacgaccggtgctcgatttagagagagtgtgttgggtttggggcccctagatcacagctcctcaccatggactggacctggagcatcctttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctggggtgcgacacggcccctggacaagggcttggagtggatgggatgggatcagtgcttaacaacggtaacaacaaactatgacacagaagttccagggcagagtccaccctgaccanacgacacactccacgagacacacgtaccaaaccgtacggacccgtgaggcgacctgacagtcgtagacgacgaccggccgttaggtattagttcgtgacggaggaagggacggggaggggggacgcggtacgtcgtttcggacgttacggcggggaccgacgggtaaccgtcggtaccgaccgttccgtccctcgaccggtaccctcccgaccgaacggaccccg

SEQ ID NO: 324416 - DNA, 659 bp, Homo sapiens
  misc_feature: GZ8MTXP02IUSTI.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacacggccctggacagggcttgagtggagtggatggatcgagtgacttaacgaaacggtaacaacaaactatgacacgagaacgttccgagggtcagacgtccacccgtgaaccacgaacgacctaacactacccgaacgacgacaacgacgtaccaaaccgtcggacctaggacggaacgccgtacgactacgtcgtacgacgaaccgacgggtacccgttagtttaattacgttggtacggaccggtaaggggacggggaacggggaagggggggacgaccgggtacggttccgttttacggaccgttacgggtcgggggaaccgtaacggggtacccgtacggtacccgaccggttccgtcccgtaccgtaccggtacccgtacccgaaccggacccgggtacccg

SEQ ID NO: 324417 - DNA, 592 bp, Homo sapiens
  misc_feature: GZ8MTXP02H7GN3.2.53.E09.1.454.CMB.2.raw
  modified_base (335)..(335): a, c, t, g, unknown or other
  misc_feature (335)..(335): n is a, c, g, or t
  modified_base (570)..(570): a, c, t, g, unknown or other
  misc_feature (570)..(570): n is a, c, g, or t
tcagacgctcgacacacgaccggtgctcgatttagagagagtgtgttgggtttgggccctagatcacagctcctcaccatggactggacctggagcattccttttcttggtggcagcagcaacaggtgcccacgcccaggttcaattggtgcagtctggaactgaggtgaagaagccgtgggcctcgagtgaggtctcctgcaaggcttctggttacattcttagcgaacttatggtatcaggtcgtgggtgcgacgacggcccgtggacaagggtcttggaggtggaagtgggatggatcgagtgtactaacgaaacggtaaaacactaaaatntagactaacgaagtaaacgttccgaagggcagacgtaccacctagaccaacgaacgacacaactaccaagacgacaacactaccaaacgcggaccgtaggaacgacgacgtagacactacgacgaacgacgacgtcgttagttacttagtgtaggacgaaggagggacgggacgggggagacgtacgtcgtttacgacgtacggtacggaccgacggtaccgcggtaccacgtcncgacgcaccaccgacgaccgcg

SEQ ID NO: 324418 - DNA, 623 bp, Homo sapiens
  misc_feature: GZ8MTXP02JT72O.2.53.E09.1.454.CMB.2.raw
  modified_base (249)..(249): a, c, t, g, unknown or other
  misc_feature (249)..(249): n is a, c, g, or t
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctggggtncgacacggcccctggacaagggcttgagtggatgggatggatcagtgacttacaacggtaacacaaactatgacacagaagttccgagggcagacgtcaccctgaccacagacacataccacgagacacacgtaccaaccgtcggaccgtagaggacgtacctgacagtctacgacgacgaccggtccgtagttagttagttaggtaggacggagggaacggggaacgggggaggggggggacggacgggtaaccggtacccggttttacggaccgttacgggtacgggggaccggtaaacggggtacccgtcggtaccgacccggttccgtcccgtccgaccgcccgtacccgaaccggaccgggtacccccg

SEQ ID NO: 324419 - DNA, 718 bp, Homo sapiens
  misc_feature: GZ8MTXP02FOEPN.2.53.E09.1.454.CMB.2.raw
  modified_base (185)..(185): a, c, t, g, unknown or other
  misc_feature (185)..(185): n is a, c, g, or t
  modified_base (389)..(389): a, c, t, g, unknown or other
  misc_feature (389)..(389): n is a, c, g, or t
tcagacgctcgacacacgaccggtgctcgatttagagagagtgtgttgggtttggggccctagatcacagctcctcaccatggactggacctggagcatccttttcttggtggcagcagcaacaggtgcccacgcccaggttcaattggtgcagtctggaactgaggtgaagagccgtgggcctnagtgaggtctctgcaggcttctggttacattctttaagcgactagtgtatcgagcgtgggtgcgacgacgggtcccctggacgtaagggtcttggaggtggagtgggaatggatcgagtgtacttaacgaaacggtaacaataaaactgtgacaacgaagtaacgttccgaagggcaacggacctccacctagacccaacgaanacctacactaccgaacgacgtacaacgtacgtaccgaaccgtcggaccgtaggacgggtactccgtacgacacgttacgacggaccgtaaaccgtccggaccggtttagttaattcggttagggaccggtacggaaggggaacgggggaaaccggggggagggggggtaaacccgtaccgggttaaccggtttacccggtttaacggtaccggttacggggacccgggggtaacccggtaaaccgggtacccgttacggtaccccgttacccgttcccgtaccgtacccgacccgtaccccgaacccggtaacccggtaccggtccccg

SEQ ID NO: 324420 - DNA, 643 bp, Homo sapiens
  misc_feature: GZ8MTXP02G5T5O.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgtactagtggtatcagcgtgggtcgcgacgacggcccctggacaagggcttggagtggagtggatggatcgagtgtaccttaacgaacggtaaacaacgtaaaactatacgacaagacggtaaacgttccgaaggggcaagcgtacccaaccgtcgaacccaagaacgacctacaactaccaacgacacaacgacgtaccaaaccgtcggaacctggaacggacgccgtacgaactactacgacgaccgaacgaccgggtccgttagttagtttagttggtacgacggaagggaacggggagggggacggggggatccggtaacgtccgtttaggaccgttacggcgggaccgaacgggtaccgtcggacccgtaccgtctccgtacgccgaccctaccggaccgaacggtcccg

SEQ ID NO: 324421 - DNA, 683 bp, Homo sapiens
  misc_feature: GZ8MTXP02FXJX5.2.53.E09.1.454.CMB.2.raw
tcagacgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacattctttagcgactatggtatcagctgggtgcgacgacggcccctaggaacaagggcttggagtggatggatggatcagtgacttaacgaacggtaacactaaaactatcgacagaagtaacgtccgaagggcaagactccaccacgaccacgagaccacactaccgacgacgacacacgtaccaaccgtcggaaccctaggaacggacgtacctacgaactacgttccgacgaaccgaaaccggtacccgggtaccgttacgtttaacgtttaagttacgggtacggacgggaagggacgggggaacgggggagggggggaccacgggtaaccggttcgtttacggaacggttacgggtaccgggggtaacccgaacggggtaccccgttacgggacccgtaacccgtccgtacccgttaccgacccggtacccctacccggaaccggtaacccggtacccccg

SEQ ID NO: 324422 - DNA, 658 bp, Homo sapiens
  misc_feature: GZ8MTXP02ISFZ5.2.53.E09.1.454.CMB.2.raw
tcagacgctcgacacacgaccggtgctcgatttagagagagtgtgttgggtttggggcccctagatcacagctcctcaccatggactggacctggagcatcctttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacagggcttgagtggatgggatggatcagtgcttacaacggtaacacaaaactatgcacagaaagttccaagggcagatcaccctgaccacagacacatcccacgacgcaacacgtaccaaacctcggaccctaggaacgggacgccctagacaacgtcctagaaccgaacgaaccgggtcccgttaggttaatttaagttgggttggacggtaagggaacgggggaacgggggaagggggggggaacggcgggaaccggtccgtttttacggaaccgttacggtacgggggacccgtaaaccgggggtaaccccgttacgggtaccgtaacccggttcccttcccgtaccggtaccggaccccttaccccgaacccgaaaaccggggtcccccg

SEQ ID NO: 324423 - DNA, 819 bp, Homo sapiens
  misc_feature: GZ8MTXP02HOYLP.2.53.E09.1.454.CMB.2.raw
tcagacgctcgacacacgaccggtgctcgatttagagagagtgtgttgggtttgggcccctagatcacagctcctcaccatggactggacctggagcatccttttcttggtggcagcagcaacaggtgcccacgcccaggttcaattggtgcagtctggaactgaggtgaagaagccgtggggcctcagtgaaggtctcctgcaaggcttcgtggttactattctttagcgtactagtggtatcagtcgtgggtgcgacgacggccccgtaggacgaacgggtcttggaggtggagtgggagtggaatcgagtgtcgttaacgaaacggtaacaaactaaaactagtacgtacgaactaaaggaaacgttaccgaagggtacaacgacgtaccacccgtacaaccgaacaagaccacactaccgaacgacgaccaacgaccgtaccaacccgtacggtacccgaggaacggccgtaccgtacgtaacgtaccgttacgaccgaaccgaccgtaacccgggtccgtttaaaggttttaaacgttttaggttaggggttacgggaaccgggaaaggggtaacgggggtaagggggtaagggggggtaaggggggggtaaccgtaacggggttaacccccgggttttacggtttttaaaccgggtaaacccggggtttacccgggggttaccgggggtaaaccccggggtaacccgggggttaaaccccggtccgggttaccccggaacccggtttcccgtaccccgttaccggaaccccggtacccccgttacccggaaaacccgggtaaaccccccgggg

SEQ ID NO: 324424 - DNA, 631 bp, Homo sapiens
  misc_feature: GZ8MTXP01CIM11.2.10.A10.1.454.CMB.2.raw
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
tcagacgctcgacacacgaccggtgctcgatttagcgtcgatctcaggggacaacaggcaggcaggggcagcaagatggtgttgcagacccgaggtcttcatttctctgttgctctggatctctggtgcctacgggacatcgtgatgacccagtctccagactccctggctgtgtctctgggcgagagggccaccatcaactgcaagtccagccagagtgtttaanacagctacaaanaaaagaactataggtagacagacaagaaacgaggacacgcctactaagctgctacaacttaccgtcgggacactaccgtaacccgggaaatcgtcgggtccctagaccgtattcccgaggtggcaggcgggtacgtagggaacgagtaatttaccactctaccaaccactaccaaccaaccgtgacagactagaagatgtacggtacgtttaattacgtagtacgtacgtactaaataattaagtacgtacgtaccgttaccgtacggtaccggttaccggtaccggaaacgggaaaccggaaacggttaaagggtaaacgttaaacgtaaaaccgtaaacgttacggttcggacgtaacgtacaaccgactacgttacgttcgttcgttaac

SEQ ID NO: 324425 - DNA, 559 bp, Homo sapiens
  misc_feature: GZ8MTXP01DIL0W.2.10.A10.1.454.CMB.2.raw
  modified_base (227)..(227): a, c, t, g, unknown or other
  misc_feature (227)..(227): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttaanacagctacaaacaaaagaactacgttaggtagtacagacaagaaacgaggacacgcctactaagctgactactaacttaccgtgggactacgtaccgtaacccgggaatccggtacggggtccctaggaccgtattcccgaggtggacgaggcgggtacgtgggaacagtatttccactctacaccactacaaccaacgtcgcaggcgtagaagatagtgtacgttacttactgtacgananaatatatgtactcctcgtcgtcgtcgacgacggaacgaacggagaagaacgaaacgaacagttcgacgtcgacaacactcttctcttctc

SEQ ID NO: 324426 - DNA, 533 bp, Homo sapiens
  misc_feature: GZ8MTXP01BLXL2.2.10.A10.1.454.CMB.2.raw
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaaacaaaaagactacttaggtgtaccagcagaaaccagggcagcctcctaagctgctcattacctggcatctacccgggaatcgtgggggtccctgaccgattccagtggcagcgggtctgggcagatttcactctcacatcaccaactgcaggctagaagatgtggtccgtttatactgtcgagtcaaattattatggtactccgtccgtgtaccgttcggaccgaaagggaaccctaaagggttggaaaacttcgaaaacgtacttggttggctgcaaccatcttagtcttctaac

SEQ ID NO: 324427 - DNA, 496 bp, Homo sapiens
  misc_feature: GZ8MTXP01A9BTV.2.10.A10.1.454.CMB.2.raw
  modified_base (240)..(240): a, c, t, g, unknown or other
  misc_feature (240)..(240): n is a, c, g, or t
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacagctaccaaanaaaagactacttaggtgaccagcagaaccaggcagcctcaagctgctcattacctggcatctacccgggaatcgtggggtccctgaccgattccaggtgcagcgggtactgggcagtatttcactctcacatcaccaactgcaggctagagatgcgcttatactgtcagtcaatatatgtactcgtcgtgtacgttcgcaaggaaccaaggttgaaattcgaaagacttgnggactgcncatcttagtcttctaac

SEQ ID NO: 324428 - DNA, 517 bp, Homo sapiens
  misc_feature: GZ8MTXP01C0KC0.2.10.A10.1.454.CMB.2.raw
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (461)..(461): a, c, t, g, unknown or other
  misc_feature (461)..(461): n is a, c, g, or t
  modified_base (483)..(483): a, c, t, g, unknown or other
  misc_feature (483)..(483): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaaacaaaaagaactacttagtggtaccagcagaaccaggcagcctccaanctgctcataccnggcatctacccgggaatcgtggggtccctgaccgtattccaggtgcagcggtctgggcagtattcactctcacatccaccaacctgcagctagagatgtggtcctttatactgtcagctaatattatgtacctctccgtgtaccgttcgacaaagggccaaggnggaaacttcgaaaacgtacggnggcttcgcacctgtctcgttcttcgaacttcccg

SEQ ID NO: 324429 - DNA, 530 bp, Homo sapiens
  misc_feature: GZ8MTXP01AC5PR.2.10.A10.1.454.CMB.2.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (266)..(266): a, c, t, g, unknown or other
  misc_feature (266)..(266): n is a, c, g, or t
  modified_base (291)..(291): a, c, t, g, unknown or other
  misc_feature (291)..(291): n is a, c, g, or t
  modified_base (432)..(432): a, c, t, g, unknown or other
  misc_feature (432)..(432): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaaanaaaagactacttaggtgacagcagaacnggcagcctctaagctgctcataccnggcatctacccgggatcgtcgggtccctgaccgattccgagtggcaggcggtctggggaacagtatttcactctcaccatccaccaacctgcaggctagaagtatgtggtccgtttaatactgtacagactaattacttancgtactccgtccggtgtaccgttcggaccaagggaaccaagggttacgaaattcgaaacgacttggttcggctgcaacctattccttgttcttctaac

SEQ ID NO: 324430 - DNA, 525 bp, Homo sapiens
  misc_feature: GZ8MTXP01B2QWX.2.10.A10.1.454.CMB.2.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (267)..(267): a, c, t, g, unknown or other
  misc_feature (267)..(267): n is a, c, g, or t
  modified_base (357)..(357): a, c, t, g, unknown or other
  misc_feature (357)..(357): n is a, c, g, or t
  modified_base (394)..(394): a, c, t, g, unknown or other
  misc_feature (394)..(394): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaaanaaaagactactaggtgaccagcagaaccnggcagcctctaagctgctcattacctggcatcctacccgggaatcgtggggtccctgaccgattccgagtggcaggcgggtctgggaacngtattcactctcacatcacaacctgcaggctagaagntgtggtcctttatactgtacgagtctaaatattatggtacctcgtaccggtggtacgttcgacgaagggaacctaaggttggaaattacgaaacgtacttggttcggctgcaaccatcttcgtcttctaac

SEQ ID NO: 324431 - DNA, 576 bp, Homo sapiens
  misc_feature: GZ8MTXP01DEFS9.2.10.A10.1.454.CMB.2.raw
  modified_base (224)..(224): a, c, t, g, unknown or other
  misc_feature (224)..(224): n is a, c, g, or t
  modified_base (394)..(394): a, c, t, g, unknown or other
  misc_feature (394)..(394): n is a, c, g, or t
  modified_base (405)..(405): a, c, t, g, unknown or other
  misc_feature (405)..(405): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgtttanacagctacaaacaaaagactactaggtgtacagcaagaaccaggacagcctacctaagctagctacattaccgtggacatccgtaacccgggaatcgtcggggtccctgaccgtattccgaggtgcgaggcggtactgggcagtatttcactctacaccatccaccaacngcagctagaantgtgtaccgtttatactgtacagtactaattattagtcggtacctccgtacggtggtaccgttacggaccgaagggaaccgtaagggttacggaaaacttacgtaaaacggaacgttggttcgggaccttaacggacctaaccgtagttcgttagttcccttcgttaaccg

SEQ ID NO: 324432 - DNA, 584 bp, Homo sapiens
  misc_feature: GZ8MTXP01C0NO5.2.10.A10.1.454.CMB.2.raw
  modified_base (225)..(225): a, c, t, g, unknown or other
  misc_feature (225)..(225): n is a, c, g, or t
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (430)..(430): a, c, t, g, unknown or other
  misc_feature (430)..(430): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgagaggccaccatcaactgcaagtccagccagagtgtttanacagctaccaaacaaaagactactagtgacagcaagaaccnggacagcctactaanctgctcattaccgtggcatccgtaacccgggaatcgtcggggtccctgaccgtattcccaggtggcaggccgggtacgtagggaacctagtatttccgacttcctaccaaccctatacccaacccgaaacctgacgaggctagaaagtntggtcgtactttatacgtgtacaagtactaattacgttgtcggtactccgtacgtggtaccgttcggaccgaaagggtaaccaagggttagaaacttacgaaaacgtcttagggttcggactgacctaacgtatccgttagttccttcgtaacc

SEQ ID NO: 324433 - DNA, 526 bp, Homo sapiens
  misc_feature: GZ8MTXP01DFV97.2.10.A10.1.454.CMB.2.raw
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
tcagacgctcgacacacgaccggtgctcgatttagcgtcgatctcagggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttaanacagctaccaaanaaaagactataggtgacagacaagaacaggcagcctactaagctgctcattaccgtggacatccgtaccgggaatcgtcgggtccctgaccgtattccgaggtggcaggcgggtctgggaacagtatttcactctacacatcacaacngnagnaganatgtgtcgttattatatacaactaaataattaatagtactcctcgtacgtacgtcgtacgaacggaacgaacggaaggaaagtaacgaaacgaaacgtaagttagcgacgcacaactctcttctcttctc

SEQ ID NO: 324434 - DNA, 580 bp, Homo sapiens
  misc_feature: GZ8MTXP01CGGXL.2.10.A10.1.454.CMB.2.raw
  modified_base (225)..(225): a, c, t, g, unknown or other
  misc_feature (225)..(225): n is a, c, g, or t
  modified_base (412)..(412): a, c, t, g, unknown or other
  misc_feature (412)..(412): n is a, c, g, or t
  modified_base (426)..(426): a, c, t, g, unknown or other
  misc_feature (426)..(426): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgaggaggccaccatcaactgcaagtccagccagagtgtttanacagctaccaaacaaaagactacttaggtgtacagcagaaccaggcagcctcctaagctgctcattacccgtgggcacgtccgtaaccccggggtaatccgtacgggggtcccctaggacccgtattccccgaggtggcaggccgggtactgggaacagtatttcactctcaccatccgacctaacngacaggctagaagntcgtggtacctttatactgtacagtactaattatagtcggtactccgtacggtcggtaacgttcggaccgaagggaacctaagggttaggaaacttacgaaaaccggtcttaggttcggctcgaccaacctatcccttagttccttaacgtccg

SEQ ID NO: 324435 - DNA, 507 bp, Homo sapiens
  misc_feature: GZ8MTXP01BOIN5.2.10.A10.1.454.CMB.2.raw
  modified_base (224)..(224): a, c, t, g, unknown or other
  misc_feature (224)..(224): n is a, c, g, or t
  modified_base (293)..(293): a, c, t, g, unknown or other
  misc_feature (293)..(293): n is a, c, g, or t
  modified_base (384)..(384): a, c, t, g, unknown or other
  misc_feature (384)..(384): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgtttanacagctacaaacaaaaagactactaggtgtaccagcagaaccaggcagcctctaagctgctcattaccnggcatctacccgggaatcgtgggtccctgaccgattccagtgcagcggtactgggcagatttcactctcacatcacaactgcagctagaanatgtgtacgttatactgtcagctaatattatggtactctcgtgtaccgttcgccgaagggaaccaaggttaggaaattcgaaaacgacttaggttcgctgacaacctatcttgtcttcgaacc

SEQ ID NO: 324436 - DNA, 573 bp, Homo sapiens
  misc_feature: GZ8MTXP01CBETC.2.10.A10.1.454.CMB.2.raw
  modified_base (413)..(413): a, c, t, g, unknown or other
  misc_feature (413)..(413): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagtagtgttttatacagctaccaaacaaaagactacgttaggtgtaccagcaagaaccagggcagcctacctaagctgctcattaccgtgggcatccgtacccgggaatccgtcgggtccctgaccgattcccaggtggcgaggcgggtctgggcagtactttcactctacaccatccaccaacctgacaggctagaagngttaggtcgtaccgtttattacgtgtcagtactaattattagtcggtacctccgtaccggtggtaccggttcggaccgaaagggaaccgtaagggttacgtaaacttacgaaacgtacgttggttcggactggaccaaccgtatccttgttccttcgtcc

SEQ ID NO: 324437 - DNA, 541 bp, Homo sapiens
  misc_feature: GZ8MTXP01DNMAT.2.10.A10.1.454.CMB.2.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (301)..(301): a, c, t, g, unknown or other
  misc_feature (301)..(301): n is a, c, g, or t
  modified_base (405)..(405): a, c, t, g, unknown or other
  misc_feature (405)..(405): n is a, c, g, or t
  modified_base (504)..(504): a, c, t, g, unknown or other
  misc_feature (504)..(504): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
  modified_base (527)..(527): a, c, t, g, unknown or other
  misc_feature (527)..(527): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtntttaanacancacaaanaaaanactagttaggtagacagacaagaaacgaggacacgcctactaagctgctactataccgnggacagtaccgtaccggatcgtcggtcctagaccgtatccgaggtggcgaggtcgggtacgtagggaactagtacttcactctaccacactaccaaccaaccgngacaggctaagaagtgtaggtcggttacctttatacgtgtacgatactaatattagtcgtacctcgtcgtgtacgtcgacgaaggaacgaaggagaaanacgaaacgattgngctnccaacntcttctcttctaac

SEQ ID NO: 324438 - DNA, 570 bp, Homo sapiens
  misc_feature: GZ8MTXP01A4OI8.2.10.A10.1.454.CMB.2.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagtagttgtttanacagctaccaaanaaaagactacttaggtgtaccagcaagaaccagggcagcctcaagctgctcattaccgtggactatccgtacccggatcgtcgggtcctgaccgtattccgaggtggacgacggcgggtactggggaactagtactttcactctacacctatacccaaccaacctgaccgaggctagaaatgtaggtcgtaccgtttatactgtacagtactaaattacttagcgttactccgtacggtgtaccgtcggaccgaaagggtaacaaagggttagaaacttcgaaaacgtacttggttcgctgaccaacctatcttacgtcttcgtaacc

SEQ ID NO: 324439 - DNA, 546 bp, Homo sapiens
  misc_feature: GZ8MTXP01APUAX.2.10.A10.1.454.CMB.2.raw
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (271)..(271): a, c, t, g, unknown or other
  misc_feature (271)..(271): n is a, c, g, or t
  modified_base (300)..(300): a, c, t, g, unknown or other
  misc_feature (300)..(300): n is a, c, g, or t
  modified_base (378)..(378): a, c, t, g, unknown or other
  misc_feature (378)..(378): n is a, c, g, or t
  modified_base (443)..(443): a, c, t, g, unknown or other
  misc_feature (443)..(443): n is a, c, g, or t
  modified_base (513)..(513): a, c, t, g, unknown or other
  misc_feature (513)..(513): n is a, c, g, or t
  modified_base (541)..(541): a, c, t, g, unknown or other
  misc_feature (541)..(541): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgagaggccaccatcaactgcaagtccagccagagtgttttanacagctaccaaanaaaagactacttaggtgtaccagcaagaaccnggacacgcctactaagctgctcattaccnggcatccgtaccggaatcgtcgggtcctgaccgattccgaggtggcgaggcgggtactagggcagtactttccactcncaccatccaaccactgcaggctaggaatgtgtacgtccgtttaatactgtacagtactaaagttnttagtcggtacctccgtacgtggtacgttcgacgaaagggcaaagggttgaaacttcgaaacgacttggngactgacctaacatcgttacgttccttntaacc

SEQ ID NO: 324440 - DNA, 620 bp, Homo sapiens
  misc_feature: GZ8MTXP01EBG8P.2.10.A10.1.454.CMB.2.raw
  modified_base (445)..(445): a, c, t, g, unknown or other
  misc_feature (445)..(445): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgttttatacagctacaaacaaaagactactaggtgacagcagaacaggcagcctactaagctgctacattaccgtgggacacgttaccgtaaccccgggtaatccgtcgggggttccccctagacccgtatttcccgaggttcggcaggtccggggtcctggggaaccaggtactttcacttcctacacctactaccacccaacctgaccagggactaggaaangttggtacggtacctttaataccgtgtacaagtactaaattattaagtcggtaaccttcccgtacggtggtacccggttacggaccgaaacgggtaaccgtaaagggttaggtaaaacttaccgaaaacgtaacttggttcggactgacaacctagtccttgttcttcgtaaccg

SEQ ID NO: 324441 - DNA, 568 bp, Homo sapiens
  misc_feature: GZ8MTXP01DUW26.2.10.A10.1.454.CMB.2.raw
  modified_base (225)..(225): a, c, t, g, unknown or other
  misc_feature (225)..(225): n is a, c, g, or t
  modified_base (296)..(296): a, c, t, g, unknown or other
  misc_feature (296)..(296): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttanacagctacaaacaaaagactacttaggtgaccagcaagaaccaggcagcctaccaagctgctcattaccgnggacatcgtaacccgggaatcgtcggggtccctagaccgattccgaggtggcaggcgggtactgggcagtatttcactctacactatccaaccaactgacgaggctagaagattcggtagtaccgtttaatacgttcggactaagtactaaattattaagtcggttacctccgtaccggtggtacgttccggaccgaagggaaccgtaaggttacgaaattaccgaaaacgattggttcgctaagactaactatcttagttcttaataaccg

SEQ ID NO: 324442 - DNA, 553 bp, Homo sapiens
  misc_feature: GZ8MTXP01AZQC5.2.10.A10.1.454.CMB.2.raw
  modified_base (225)..(225): a, c, t, g, unknown or other
  misc_feature (225)..(225): n is a, c, g, or t
  modified_base (357)..(357): a, c, t, g, unknown or other
  misc_feature (357)..(357): n is a, c, g, or t
  modified_base (528)..(528): a, c, t, g, unknown or other
  misc_feature (528)..(528): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgagaggccaccatcaactgcaagtccagccagagtgtttanacagctaccaaacaaaagactacttaggtgtacagcagaaccaggcagcctactaagctgctcattacctggcatccgtaacccgggaatcgtcggggtccctgaccgattcccaggtggcaggcgggtacngggaacagtatttcactctcacctatccaccaacctgacaggctagaacgtagtcggtcggtacccgtttaattacctgtacagtactaaattacttagtcggttactccgtacggtggtaccgttcggaccgaagggaaccaagggttagaaacttacgaaacgattggngctgcaactatcttgtcttcgtaac

SEQ ID NO: 324443 - DNA, 597 bp, Homo sapiens
  misc_feature: GZ8MTXP01ELZ1R.2.10.A10.1.454.CMB.2.raw
  modified_base (225)..(225): a, c, t, g, unknown or other
  misc_feature (225)..(225): n is a, c, g, or t
  modified_base (295)..(295): a, c, t, g, unknown or other
  misc_feature (295)..(295): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgaggaggccacatcaactgcaagtccagccagagtgttttanacagctaccaaacaaaagactacttaggtgtaccagcagaacaggcagcctactaagctgctcattaccnggacatcgtacccgggaatcgtagggtccctgacctattccaggtggcaggcgggtctgggaacngtatttccactcncaccatccgacaacctgacaaggctagaagtattcggtacggtaccgttttaattaccgtggttacgaagtacctaaattatttaatcgggttaaccttcccgtaccggttcgggtaaaccgttccgggacccgaaaggggtaaccctaaagggttaacggaaacttacgaaaacgtaacgttggttcggactaaggccaacctattcgttgttccttctaacc

SEQ ID NO: 324444 - DNA, 613 bp, Homo sapiens
  misc_feature: GZ8MTXP01BTMJG.2.10.A10.1.454.CMB.2.raw
  modified_base (230)..(230): a, c, t, g, unknown or other
  misc_feature (230)..(230): n is a, c, g, or t
  modified_base (281)..(281): a, c, t, g, unknown or other
  misc_feature (281)..(281): n is a, c, g, or t
  modified_base (311)..(311): a, c, t, g, unknown or other
  misc_feature (311)..(311): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgcaagtccagccagtagttgtttanacagctaccaaaacaaaaagactacgttaggtaggaccagacaagaaaccngggcagcctactaagctgctacattaccgnggacagtccgtaacccgggatccggtcggggtccctgaccgtattccgagtggcaggcgggtctagggcagtacttcactctacacatccaaccactgacaggctagaagtagtggtacgtaccgtttaatacgtgtacaagtactaaattagttagtcggttacctccgttaccggtaggtacccggttacggaacccgaagggggaacccgtaaagggttacggtaaaacttccgaaaacggtacgttgggttcggaccttcgacctaacctagttcgttacgttccgttaacgtaaccc

SEQ ID NO: 324445 - DNA, 757 bp, Homo sapiens
  misc_feature: GZ8MTXP01DWCN8.2.10.A10.1.454.CMB.2.raw
  modified_base (230)..(230): a, c, t, g, unknown or other
  misc_feature (230)..(230): n is a, c, g, or t
  modified_base (309)..(309): a, c, t, g, unknown or other
  misc_feature (309)..(309): n is a, c, g, or t
  modified_base (476)..(476): a, c, t, g, unknown or other
  misc_feature (476)..(476): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctggggcgaggagggccaccatcaactgcaagtccagccagtagttgttttanacagctaccaaacaaaaagactacttaggtgaccagcaagaaaccagggcagccctactaagctgctactattacccgnggactactccgtaacccgggtaatccggtcggggtcccctggaccgtattcccgaggtggcgagggtccggggtacgtagggaacagtactttaccaactcctaccaacctaactacccaaacccgtaaaccgtggaccgtaacgggtcctaaagggaaaacggttnttacggggttaccggttaaccccgtttttaataacccgttggtaccgaaaaggttacttaaaaagtttacgtttaacggtacgggtttaaccccttcccggttacccgggttacggggtaacccgggtttcccggggaaacccgtaaaacggggggttaaacccaaagggggtttaaacggaaaaaaccttacccggaaaaaacggtaaccggttggttaccgggacttaacggaccctaaccttaacgttcggttacgttaaccgtttaaccgtaacccg

SEQ ID NO: 324446 - DNA, 589 bp, Homo sapiens
  misc_feature: GZ8MTXP01C03OK.2.10.A10.1.454.CMB.2.raw
  modified_base (228)..(228): a, c, t, g, unknown or other
  misc_feature (228)..(228): n is a, c, g, or t
  modified_base (274)..(274): a, c, t, g, unknown or other
  misc_feature (274)..(274): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttanacagctaccaaacaaaagactacttaggtgtaccagcaagaaaccnggcagcctacctaagctgctacattaccctgggacactccgtaaccccgggaatccgtagggggtcccctagaccgtatttccgaggtggcaggcggtctaggggaaccagtatttccactctacaactatacaaccaacctgccaggctaggaagatcggtgtaccgtttaattactgtacaagtactaattagttatacggtactccgtacgtggtaccgttacggaccaaaggggtaacccaaagggttaggaaaacttacgtaaaacggcttaggcgttctaagaccaactagtcttggtaacttcgtaac

SEQ ID NO: 324447 - DNA, 725 bp, Homo sapiens
  misc_feature: GZ8MTXP01C5PW9.2.10.A10.1.454.CMB.2.raw
  modified_base (232)..(232): a, c, t, g, unknown or other
  misc_feature (232)..(232): n is a, c, g, or t
  modified_base (652)..(652): a, c, t, g, unknown or other
  misc_feature (652)..(652): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagacctccctggctgtgtctcgtggcgagagggccaaccatcaactgacaagtccagccaagtagttgtttaanacagacctaaccaaaacaaaaaagtaactaacgttaaggtacggtaaccaagacaaacgaaaccgagggcacgccctacgtaagctgactacattaccgtggcacgtccgtaacccggatcgtcgggtccctagaccgtattcccgaggtcgcgagggtccggtacgtaggggaactaggtactttaccgacctaccgtacccaacctaactacccgaaaccctaaacccgttcgaccgtaagggtacctaagggaaatcggttacggttagggttaccccttttaataacgtcgttacggaacgttaaactaaagttaacgttagttccggtaaccctttcccggtaaccgggtacggttacccggttccccgggaaccggtaaaggggaaacccgtaaggggttaacggtaaaaaccnccggtaaaaaaccggtagttcgggttcgaccgttaacgacccaaccctagtcctttagtccctttctaacccg

SEQ ID NO: 324448 - DNA, 697 bp, Homo sapiens
  misc_feature: GZ8MTXP01DWJ0W.2.10.A10.1.454.CMB.2.raw
  modified_base (228)..(228): a, c, t, g, unknown or other
  misc_feature (228)..(228): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagagttgtttanacagctaccaaacaaaaagactacttaggtgaccagcaagaaaccagggcagcctactaagctgcctcattaccgtggacagtccgtaacccgggtatccgtcgggggtcccctggaccgtattccgaggtcggcgaggtccgggtccgagggaaccagttactttccactcctacacctactaccacccaacctgacagggtcctaggaaagtagttgggtacggttaccttttaagttacttcggttacgaacgtacttaaaatttacgtttaaacgttcggtttaacccttcccggtttacccggggttacgggtaacccggtttacccgggaacccggtaaaacggggtaaacccggtaaaggggttaaacgggaaaaacttaccgaaaaaaccggttaacgttgggttcggaccgttaacgacccgtaacctagttccgttgttaacccgtttaacctaacccg

SEQ ID NO: 324449 - DNA, 561 bp, Homo sapiens
  misc_feature: GZ8MTXP01CJAZR.2.10.A10.1.454.CMB.2.raw
  modified_base (227)..(227): a, c, t, g, unknown or other
  misc_feature (227)..(227): n is a, c, g, or t
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (326)..(326): a, c, t, g, unknown or other
  misc_feature (326)..(326): n is a, c, g, or t
  modified_base (361)..(361): a, c, t, g, unknown or other
  misc_feature (361)..(361): n is a, c, g, or t
  modified_base (410)..(410): a, c, t, g, unknown or other
  misc_feature (410)..(410): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagtgtttanacagctaccaaacaaaagactacttaggtgtacagacaagaacnggcagcctcaagctgctcattaccgnggcatccgtaccgggatcggtcgggtccngacgtattccgaggtgcaggcgggtctacgggaanagtatttcactccacaccactaccaccaaccgtgacgaggctagaagtntcggtcgtaccgttttatacgtggtacagtaactaattacttacgtcggtaccttccgtcgtacggtaccgttcggaaccgaagggaaccagggttagaaacttacgtaaaacgtgttcgttggctcgctaacatcttagtccttcgtaac

SEQ ID NO: 324450 - DNA, 548 bp, Homo sapiens
  misc_feature: GZ8MTXP01EPKNQ.2.10.A10.1.454.CMB.2.raw
  modified_base (295)..(295): a, c, t, g, unknown or other
  misc_feature (295)..(295): n is a, c, g, or t
  modified_base (394)..(394): a, c, t, g, unknown or other
  misc_feature (394)..(394): n is a, c, g, or t
  modified_base (527)..(527): a, c, t, g, unknown or other
  misc_feature (527)..(527): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctacaaacaaaagactacttaggtgtacagacagaaccaggcagcctctaagctgctcattaccnggcatcgtacccgggaatcgtgggtccctgaccgattccagtggcaggcggtctgggaacagtattcactcacaccatcaccaactgcaggctagagtntgtgtaccgtttatactgtagactaattattatcggtacctccgtcgtaggaccgttcggaccgaagggaccaaagggtacggaaataccgaaaacgtacgtggttggccttggaacctacctaagttccgtnttccttaacttaacttccccg

SEQ ID NO: 324451 - DNA, 647 bp, Homo sapiens
  misc_feature: GZ8MTXP01A9D81.2.10.A10.1.454.CMB.2.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (271)..(271): a, c, t, g, unknown or other
  misc_feature (271)..(271): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaaanaaaagactacttaggtgtaccagcaagaaaccngggcacgcctacaagctgctactacttaccgtggactacgtaccgtaacccgggatcggtccgggtccctaggaccgtacttccgaggtcggcgtacgggccggtacggtagggaacgtagtactttcgaccttcaccacacgtccaaaccctacgtgacgacggtcaaggaacgtgtgggttcggttacgtttacttacgttgtaaccgagtaacttaaattagtttacgtccgggttaaccttccccggttcgggttacggtacccgggtttaccggaacccgggtaaacgggaaccggtaaagggttaaggtaaacgttaccgaaaacgtcgttaggttcgactgaccaactatcgttacttcttaactcccg

SEQ ID NO: 324452 - DNA, 624 bp, Homo sapiens
  misc_feature: GZ8MTXP01B4789.2.10.A10.1.454.CMB.2.raw
  modified_base (229)..(229): a, c, t, g, unknown or other
  misc_feature (229)..(229): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagtagttgtttanacagctaccaaacaaaagactattaggtgtaccagacaagaacaggcagcctacaagctgctacacttaccgtggacacgtaccgtacccgggaatccggtacgggggtccccaggacccgtattcccgaggtcggcgacggtcggggtacgtacgggaactaggtacttttccgaccttcctaccaacctactcccaacccaaccgtgacaggctaaggagtagtggtcggttacctttaagtactcgtacaagtactaattattacgtgttacccttccgttaccggtggtaccggttaccggacgtaacggggaacctaagggttaggtaaacttacgaaaacggtacgttgcggttacgtgacctaactagtcttacgtccttaacgtccg

SEQ ID NO: 324453 - DNA, 585 bp, Homo sapiens
  misc_feature: GZ8MTXP01AXMJI.2.10.A10.1.454.CMB.2.raw
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (268)..(268): a, c, t, g, unknown or other
  misc_feature (268)..(268): n is a, c, g, or t
  modified_base (295)..(295): a, c, t, g, unknown or other
  misc_feature (295)..(295): n is a, c, g, or t
  modified_base (405)..(405): a, c, t, g, unknown or other
  misc_feature (405)..(405): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttanacagctaccaaanaaaagactacttaggtgtaccagcagaaccnggcagcctctaagctgctcattaccgnggcatcgtaacccgggaatccgtgggggtcccctgaccgtattcccgaggtggcaggcggggtctgggtaacagtatttcactctcacactcaccactgcagctagaagntcgtgtccgtttatactgtacagtactaaattagttaagtcggttaccttccgtccggtacgggtaccgttcgggaacccgaaaggggaacccgaaagggttacggaaacttaccgaaaacggtacttgggttacgccgtaacgacaacccgtattcccttgttaacccgttctaacccg

SEQ ID NO: 324454 - DNA, 550 bp, Homo sapiens
  misc_feature: GZ8MTXP01AB704.2.10.A10.1.454.CMB.2.raw
  modified_base (227)..(227): a, c, t, g, unknown or other
  misc_feature (227)..(227): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttanacagctaccaaacaaaagactactaggtgtacagcagaaccagggcagcctactaagctgctcattacctggcatcgtacccgggaatcgtgggtccctgaccgtattccaggtgcgaggcgggtctgggcagtactttcactctacaccatccaccaactgcaggctagagtatggtgtccgtttattactgtacagtactaattacgttatcggtacctccgtcgtcggtaccgttcggaccgaagggaaccaagggttacgaaacttcgaaacgtacttggttggctcgcctaacctagtccgttgttccgttcgtaacc

SEQ ID NO: 324455 - DNA, 645 bp, Homo sapiens
  misc_feature: GZ8MTXP01D8Z94.2.10.A10.1.454.CMB.2.raw
  modified_base (230)..(230): a, c, t, g, unknown or other
  misc_feature (230)..(230): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtggggcgaggagggccacatcaactgcaagtccagccagtagttgttttanacagactaccaaacaaaaagactacttaggtgaccagacaagaaaccagggacagcctactaagctgctcattaccgtgggactactccgtaaccccgggtaattccggtcgggggttcccctggacccgtatttccgaggtggcacggtcggggtacgtgggaactagtactttaccacctctacacctactacccaacctaactgaccgaggacttaggaaagtgttcggtacggttacccttttagtaacgtcgttacaacggtacttaaattagttagtacggttaccttcccgttacggtgggtaccgttccggaaccgaaacggggtaacctaaagggttacgtaaacgttacgaaaaccgtacgttaggttgttactcgactaaccgattcgttgttcttcgtaaccg

SEQ ID NO: 324456 - DNA, 604 bp, Homo sapiens
  misc_feature: GZ8MTXP01BV0P6.2.10.A10.1.454.CMB.2.raw
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacagctaccaaacaaaagactacttaggttgtaccagcaagaaccgaggcagccctacctaagctgctcattaccgngggcatccgtacccgggaatccgtcgggtccctagaccgtattccgagtggacgaggcggtactgggctagtacttcgactctacacctatccaaccaacctgacaggctaacggaagtgtcggtcggttaccgtttaattacgtgtaccgaagtactaaattattacgtcggtaccttccgtaccggtggtaccgttccggacgtaacgggaacctaagggttagaaaacttacgaaaacgtcgttaggttcggttactaacggaccaaccgtattccgttagttcccttcgttaacccg

SEQ ID NO: 324457 - DNA, 720 bp, Homo sapiens
  misc_feature: GZ8MTXP01AT76O.2.10.A10.1.454.CMB.2.raw
  modified_base (684)..(684): a, c, t, g, unknown or other
  misc_feature (684)..(684): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgccgtacggggacatcgtgatcgacccagtctccagacctcctggctgtcgtctcgtgggcgaggacgggcccacatacaactgacaacgtccagccagtagttgtttaacacagacctaaccaaaacaaaaagtactacgttaggtacgtaccagacaaacgaaccgagggacacgaccctacgaagtctgacctactacgttaccgtgggactaacgttccggtaacccgggtaatccggttccgggggtacccctaggtaacccgttagttacccggaggtcgggacgtacggggtccgggttacgtacgggaactagttacctttaccaccttccaccctaaaccactaccctaacccgtaacgtgactacgggattacggaagttatcgggttacgttaccgttttaacgtacgttcggtaactaagtaacctttaaattagttacgtaccggttacccttccggtccggtacggtaccgggttacccgacggtaaacgggaacgtaaggttaaggtaaacaccggtaaaacgtacgttggttcgttaccgtntaccgaacttatccgttactcgtttaacctaacccg

SEQ ID NO: 324458 - DNA, 659 bp, Homo sapiens
  misc_feature: GZ8MTXP01ALHC5.2.10.A10.1.454.CMB.2.raw
  modified_base (230)..(230): a, c, t, g, unknown or other
  misc_feature (230)..(230): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccacatcaactgcaagtccagccagtagttgttttaanacagctaccaaaacaaaaagaacttacgttaggttcggtaaccagacaagaaaccagggacacgcctacgtaagctgctactacttaccgtgggactacgtaccgtaacccgggtaatccggtcgggggtccctggaaccgtactttcccgaggtcggcgtacggtcggggtacttagggtaactagtactttcacctctaccaaacctactacccaacctaaccgtggcaaggacgttaaggaagtagtcggtacggttacctttagttacgtgtacaagtactaattattaagtcgtactccgttacggcggtccgttacggaacgaaggggaaccgtaaagggacggtaaaacttaccggtaaaacgtaacgttcggttggaccgtaacgaccgtaactacgttcgttacttccgttcttaacccg

SEQ ID NO: 324459 - DNA, 647 bp, Homo sapiens
  misc_feature: GZ8MTXP01DNAKO.2.10.A10.1.454.CMB.2.raw
  modified_base (230)..(230): a, c, t, g, unknown or other
  misc_feature (230)..(230): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgacaagtccagccagtagttgttttanacagctaccaaacaaaagactacgttaggtgtaccagcaagaaaccgagggacacgcctacctaagctgctactacttaccgtgggactacgtaccgtaacccggggaatccggtacgggggtccctagaccgtattcccgaggtcggcgacggtcgggtacgtaggggaactagtactttcactcctaccaccactacccaaccaaccgtgacgtaggactaggaaagtgtcgtaggtacctttatacgtagttacaagtacctaaattacgttagtcggttacctccgttaccggtggtaaccggttcggaacccgtaagggggtaaccctaaaggggttacgtaaaacttaccgaaaaccggtagttagttcggacctcggacaacccgttatccgttagttccttctaacccg

SEQ ID NO: 324460 - DNA, 616 bp, Homo sapiens
  misc_feature: GZ8MTXP01EEFKB.2.10.A10.1.454.CMB.2.raw
  modified_base (226)..(226): a, c, t, g, unknown or other
  misc_feature (226)..(226): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgttttanacagctacaaacaaaagactacttagtgtaccagcaagaaaccagggcagtctacctaagctgctcaattacctggcagtccgtacccgggaatccgtgggtccctggaccgtattccgaggtggcgaggtcggggtctacggggaactagtactttcactctacacctatccaactaaccgtgacagggtactaggaaatgttggtacggtaccgtttaattacgtgttaccgagtactaaattactagtcggttacctcgttaccggtggtaccggttaccgaccgtaaagggaaccctaaaggggttacggaaaacttaccggaaaacgaacgttcggttcggacgtcgaccgtaactaacttcttacgttccgttaaccttaaccg

SEQ ID NO: 324461 - DNA, 632 bp, Homo sapiens
  misc_feature: GZ8MTXP01C4ZP1.2.10.A10.1.454.CMB.2.raw
  modified_base (227)..(227): a, c, t, g, unknown or other
  misc_feature (227)..(227): n is a, c, g, or t
  modified_base (276)..(276): a, c, t, g, unknown or other
  misc_feature (276)..(276): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagttgtttanacagctaccaaacaaaagactacgttaggtgtaccagacaagaaaccgngggacacgcctacctaagctgctacacttaccgtggctacgtccgtaaccccgggtaatccggtcggggtcccctaggaccgtacttccgaggtcggcgaggccgggtacgtgggaactagtactttcactctcaccatccaccactgcaggctagagtatcggtcggtaccctttaatacgtgtacgaacgtactaaattacgtttagtccggttacctccgttaccggtacgggtacccggttacgggacccgtaaaggggtaacccgtaaagggttacgggtaaaacttccgaaaaaacggtcttgggttacgcgtaacacctaacgtattccgttcgtcctttcgtaacccg

SEQ ID NO: 324462 - DNA, 715 bp, Homo sapiens
  misc_feature: GZ8MTXP01AV9FZ.2.10.A10.1.454.CMB.2.raw
  modified_base (228)..(228): a, c, t, g, unknown or other
  misc_feature (228)..(228): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagttgtttanacagctaccaaacaaaagactacttaggttggtaccagacaagaaccgagggcagcctactaagctgctactacttaccgtggcacgtaccgtacccgggtaatccggtcggggtccctaggacccgtattcccgaggtcggacgtacgggtccggggtacctaggggaacctagggtactttcccgaccttcctaccaacctactacccaaaccctaacctggaccgaggtctaaggaaagtgttcggtcggttaccctttatacgttacggtaccgtaagtaaccttaaagttacgtttaacgttaccgggttaccccttcccggttacccgggttacggttaaccccggttccgggaacccggtaaacggggtaaccccgtaaaggggttacggtaaaacttaccggaaaacggtaacgttcgggttcggaccctaacggaccctaaccgttcgttaccgttacgttaacccttcgtaaccccg

SEQ ID NO: 324463 - DNA, 737 bp, Homo sapiens
  misc_feature: GZ8MTXP01AQ748.2.10.A10.1.454.CMB.2.raw
  modified_base (233)..(233): a, c, t, g, unknown or other
  misc_feature (233)..(233): n is a, c, g, or t
  modified_base (285)..(285): a, c, t, g, unknown or other
  misc_feature (285)..(285): n is a, c, g, or t
  modified_base (321)..(321): a, c, t, g, unknown or other
  misc_feature (321)..(321): n is a, c, g, or t
  modified_base (364)..(364): a, c, t, g, unknown or other
  misc_feature (364)..(364): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgccgtacggggacatcgtgatcgacccagtcctccagacctccctggctgtgtctcgtgggcgagacggccaccatcaactgcaagtccagccagtagttgtttaanacagacctaccaaacaaaagtactacgttaggtcgtaccagacaagaaccgnggacacgccctaccaagcctgactacacgttaccgnggacctacgtacccgtaacccgggtaatccggtcggggtcccnggaccgtattcccgaggtggcgaggtcggtcgacgggaactagtactttcacctcctaccaacctactaccccaaacccgtaaccgtggacccgaggtccgtaagggaaacgttacggttcgggttaccgggtttacccttttaagtaaccgttcgtaaccgtaagtaccttaaattacgtttaccgtacggttacccctccggttaccgggtacgggtaaccccgttacgggaacccgtaaaacgggggaacccctaaaaggggttaacggtaaaaccttaccggtaaaaaacccggtacgttgggttaaccgccgttaaccggaccctaacccttacggttccgttacgtttaaccccttaacgttccccg

SEQ ID NO: 324464 - DNA, 652 bp, Homo sapiens
  misc_feature: GZ8MTXP01EC7V6.2.10.A10.1.454.CMB.2.raw
  modified_base (228)..(228): a, c, t, g, unknown or other
  misc_feature (228)..(228): n is a, c, g, or t
  modified_base (406)..(406): a, c, t, g, unknown or other
  misc_feature (406)..(406): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagtagttgtttanacagactacaaacaaaagtactacgttaggtgacagacaagaaccagggacagcctacctaagctgcctacaattacccgtgggactacgttaccgtacccgggtaatccggtcggggtccctagaccgtattcccgagtggcgaggcgggtacgtgggaactagtatttccacttcncgaacctactacccaacccaaccgtgaccagggactaggtaaagtagttcggtcggttacgtttaattacgtgtacaagtactaaatttagttaacgtcggttaaccgttcccgtaccggttcgggtaccgttaccgggaaccggtaaaggggaaccgtaaagggttaaggtaaaacttacgaaaaccggtaagttcgggttcgaccgtaacgactaactcgttacttcgttaaccttcctaaccg

SEQ ID NO: 324465 - DNA, 588 bp, Homo sapiens
  misc_feature: GZ8MTXP01CTRCB.2.10.A10.1.454.CMB.2.raw
  modified_base (229)..(229): a, c, t, g, unknown or other
  misc_feature (229)..(229): n is a, c, g, or t
  modified_base (313)..(313): a, c, t, g, unknown or other
  misc_feature (313)..(313): n is a, c, g, or t
  modified_base (434)..(434): a, c, t, g, unknown or other
  misc_feature (434)..(434): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagtagttgtttanacagctaccaaacaaaagtactacgttaggttacgtaccagacaagaaccgagggaccagcctcctaagctcgctcattaccgnggcataccgtacccgggtaatccgtcgggtccctgaccgtattccgaggtgcgaggcgggtactgggaacagtatttccactcctacaccactacccacctaaccgtgcaggctagaagtntggtcgtactttatactgtacgagtactaattattcgtcgtacctccgtcggtcggtaccgttacggaccgtaagggaaccgaagggttaggaaaacttcgtaaaaccgcgttggcggactcggacctaaccgtatccgttatccttccgtccg

SEQ ID NO: 324466 - DNA, 672 bp, Homo sapiens
  misc_feature: GZ8MTXP01ASRHR.2.10.A10.1.454.CMB.2.raw
  modified_base (235)..(235): a, c, t, g, unknown or other
  misc_feature (235)..(235): n is a, c, g, or t
  modified_base (386)..(386): a, c, t, g, unknown or other
  misc_feature (386)..(386): n is a, c, g, or t
  modified_base (612)..(612): a, c, t, g, unknown or other
  misc_feature (612)..(612): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgccgtacggggacatcgtgatcgacccagtcctccagacctccctggctgtgtctcgtgggcgaggacggcccaccatcaactgacaagtccagccagtagttgtttanacagacctaaccaaaacaaaaacgtacttaacgttagggttacgtaaccagaccaaaggaaaccgagggaccacgccctaccaagctgacctactattaccgtggactacgtaccggtacccgggtatccggtacgggtcctacgaccgtnttccgaggtcggcgacggtcgggtactacgggaactagtacctttcgaccttccaccaacctactacccaacctaacgtcgacgacggtacgtagtaacggtgtcggttaccggttacgttttaactcgtacgtacgtaggtaactaaatttgttacgtcgtacccttcccggttcggtacggtaccggttaccggaaccggaaacgggtaaccgtaagggttaanaaacgttacgaaacgtcgttgttacgctaacgcgtaactagttcttactcttcttaaccg

SEQ ID NO: 324467 - DNA, 684 bp, Homo sapiens
  misc_feature: GZ8MTXP01BAATY.2.10.A10.1.454.CMB.2.raw
  modified_base (232)..(232): a, c, t, g, unknown or other
  misc_feature (232)..(232): n is a, c, g, or t
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgccgtacggggacatcgtgatcgacccagtctccagactccctggctgtgtctcgtgggcgaggacgggccacatcaactgacaagtccagccagtagttgtttanacagacctaaccaaaacaaaaagtacttaacgttaggtagtaaccagacaagaaaccgngggacacgcctacaagctgctactagttccgngggactagtaccgtaacccgggatccggtcgggtccctacgacgtacttcgaggtggcgaggtccgggtacgtagggaactagtactttccgactcctaccaacctactacccaacccacgtgacgacggtacttaaggaacgttgtcgggtacggttaccctttttaatacgttacggacgtaacggtaaccttaaagtttacttagttaccggttaacccttccggttaacggtcggtaaccggttaccggaaccgtaaacggggaaccgtaaagggttaggtaaaacttacggtaaaacgtacgttgggttcggacccttaagacccgtaactagttcttacgtcctttcgtaacccg

SEQ ID NO: 324468 - DNA, 891 bp, Homo sapiens
  misc_feature: GZ8MTXP01AVYS5.2.10.A10.1.454.CMB.2.raw
  modified_base (231)..(231): a, c, t, g, unknown or other
  misc_feature (231)..(231): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgccgtacggggacatcgtgatgacccagtctccagacctcctggctgtgtctcgtgggcgaggacgggccaccatcaactgacaagtccagccagagttgtttanacagacctaaccaaacaaaacgtaacttacgttaggttacggtaaccagacaacgaaaccgagggacacgtcctcctaagctcgctacacgttaccgtgggactacgtaccgtaacccgggtaatccggttacgggggtccctacggaccgtacgttacccgtaggtacggtacggtacgggcccgggttacgggtacgggtaacccgtaaggtaaccttttaccgtaacccgttaccttacccgaaacccttaaccctaccccaaaaccccgtaacccgttacggtaccgggaacggtaacccgtttaaggaaaccggtttaaggtttcggggttaaaccggttttcccgttttttaaaacgtttcccggttacgtttaccggaacggttaaccttaaaacccttttaaagtttaaccggttaaccgggttaaccccgtttcccggtttacccgggtttaccgggggtaacccggggttacccgggttaaaccccggggaaaacgggttaaacccgggtaaaaggggttaacggtaaaaaccgttaaacccggtaaaaccggttaaacccgggttgggtttaacccgggacggttaacccgccctaaacccggttactttcccgttacggtttaacccgttaaccttttaacccccggg

SEQ ID NO: 324469 - DNA, 759 bp, Homo sapiens
  misc_feature: GZ8MTXP01A8WPT.2.10.A10.1.454.CMB.2.raw
  modified_base (239)..(239): a, c, t, g, unknown or other
  misc_feature (239)..(239): n is a, c, g, or t
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgccgtacggggacatcgtgatcgacccagtcctccagacctccctggctgtgtctcgtgggcgaggacggcccaccatacaactgacaacgtccagccaagtagttagtttanacacgacctaaccaaaacaaaagtacttacgttaggtacgaaccagacaacgaaccgnggacacgccctacgaagctgctactagttccgnggactacgtaccggtacccggtatccggtcgggtccctacggtaccgtagttacccgaggtcggacgtacgggtccgggtacgtacggggtaacctaggtacctttaccaccttacccgtacccaacctacttaccccaaacccgtaaccgtggaccgtaggtacttaagggaattacggttcgggttcgttaacccgttttataccgttaggaccttaaacggtactttaaaagtttcgttacgttcccggttacccttcccggttaccggggtaaggttacccggggttacccggaaacccggtaaacggggaaccgtaaaggggttaacgaaacctttaaaccggaaaacggttacggttcgggttaacgttcccgttaaggaccccttaacgttacgttccgttaacgttcccttaactcccccg

SEQ ID NO: 324470 - DNA, 550 bp, Homo sapiens
  misc_feature: GZ8MTXP02H5O5A.2.10.A10.1.454.CMB.2.raw
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (352)..(352): a, c, t, g, unknown or other
  misc_feature (352)..(352): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctggcgagaggccaccatcaactgcaagtccagccagagttgtttanacagctaccaaanaaaagactactaggtgacagcagaaaccaggcagcctctaagctgctcattaccgtggcagtcctacccgggaatcgtggggtcccctgaccgattcccagtcggcaggcgggtntcggggacagtactttcactctcaccatccaccactgcaggctagaagatgtgtccgtttaatacctgtacagtactaatattagttggtaacctccgttcggtggtaccggttcggaccgaaaagggtaccaaaagggttcggaaaactcgaaaacggtactggtgacctaagacaccgtatctcgtcctttacacc

SEQ ID NO: 324471 - DNA, 507 bp, Homo sapiens
  misc_feature: GZ8MTXP02GWZ9M.2.10.A10.1.454.CMB.2.raw
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (425)..(425): a, c, t, g, unknown or other
  misc_feature (425)..(425): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctaccaaanaaaagaactacttaggtggtaccagcagaaaccaggcagcctctaagctgctcattacctggcatctacccgggaatcgtggggtccctgaccgattccagtgcagcggtctgggcagatttcactctcaccatcaccaacctgcaggctagaagatgtgccgtttattactgtcagcaatattangtactctccgtggaccgttcgccaagggaccaaggtaggaaaatacgaaaacgactgtaggctgacaccatctcgtctctac

SEQ ID NO: 324472 - DNA, 593 bp, Homo sapiens
  misc_feature: GZ8MTXP02G2H08.2.10.A10.1.454.CMB.2.raw
  modified_base (224)..(224): a, c, t, g, unknown or other
  misc_feature (224)..(224): n is a, c, g, or t
  modified_base (295)..(295): a, c, t, g, unknown or other
  misc_feature (295)..(295): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttanacagctaccaaacaaaagactacttaggtgtaccagcagaaaccaggcagcctctaagctgctcattaccnggcatctacccgggaatcgtggggtccctgaccgtattccgagtggcaggcgggtctggggcagtatttcacgtctcaccatccaccaacctgcaggctagaagatgtggtacctttatactgtacagtacaaagttacttaagtcggttacctccgttacgtcggtaaccggtttcgggaaccgtaaacggggtaaccgaaaagggtaggtaaaacgtaccgaaaaacgtaaccgtaggtacggtaccgtaaggaccctaaacccgtacttaccgttacgttccctttactaacccg

SEQ ID NO: 324473 - DNA, 506 bp, Homo sapiens
  misc_feature: GZ8MTXP02H40Z6.2.10.A10.1.454.CMB.2.raw
  modified_base (238)..(238): a, c, t, g, unknown or other
  misc_feature (238)..(238): n is a, c, g, or t
  modified_base (431)..(431): a, c, t, g, unknown or other
  misc_feature (431)..(431): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctaccaaanaaaaagactactaggtgtaccagcagaaaccaggcagcctcctaagctgctcatacctggcatctacccgggatcgtggggtccctgaccgattccagtggcaggcgggtctgggcagtatttcactctcacatcaccaactgcaggctagagatgtggtcttatactgtcagtcaatattatgtactctcgngtacgtcgactaagggacctaaggtagaaactcgaaaacgacgtagtcggctaagcctacactctcgtcttacac

SEQ ID NO: 324474 - DNA, 510 bp, Homo sapiens
  misc_feature: GZ8MTXP02HEYML.2.10.A10.1.454.CMB.2.raw
  modified_base (300)..(300): a, c, t, g, unknown or other
  misc_feature (300)..(300): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctaccaaacaaaagaactacttaggtggtaccagcagaaaccagggcagcctcctaagctgctcattaccnggcatctacccgggatcgtggggtccctgaccgatccgagtggcaggcggtctgggcagtattcactctcaccatcaccaacctgcaggctagaagatggtggtaccgtttattactgtacagtactaatattatgtacctcgtcgtggtacgttcgcaagggaccaaggtaggaaactacaaacgactgtgctgcacatctgtctctac

SEQ ID NO: 324475 - DNA, 571 bp, Homo sapiens
  misc_feature: GZ8MTXP02GCWDD.2.10.A10.1.454.CMB.2.raw
  modified_base (227)..(227): a, c, t, g, unknown or other
  misc_feature (227)..(227): n is a, c, g, or t
  modified_base (308)..(308): a, c, t, g, unknown or other
  misc_feature (308)..(308): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaaacaaaaagaactacttaggttgtaaccagacaagaaaccagggcagccctacctaagctgctcattaccnggcatcgtacccgggaatccgtggggtccctgaccgattccgagtggcaggcgggtctggggacagatttcactctcaccatccaaccaacctgcaggctagaaagtatgtggtacccgtttaattacctggtacaagctaaattattaatggtacctccgtcggtaggaccgttcggacccgaaagggaccaaagggtaggaaaacttaacgaaaacgactaggtcggactaagaccaactactctcggtaccttactaccg

SEQ ID NO: 324476 - DNA, 587 bp, Homo sapiens
  misc_feature: GZ8MTXP02I56LU.2.10.A10.1.454.CMB.2.raw
  modified_base (433)..(433): a, c, t, g, unknown or other
  misc_feature (433)..(433): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaaacaaaagaactacttaggttggtaccagcagaaccagggcagcctcctaagctgctcattacctggcatcgtacccgggatccgtggggtccctgaccgtattccgagtggcaggcgggtctggggcagtactttcactctcaccatccacactgcagctagacgatgtgtccgttatactgtacagtctaaattnttaagtcggtaccttccgtacggtaggtaccgtttacgggaccgtaaaggggtaacccaaggggttacggaaaacttaaccgaaaacggtaaccgtaggtacggtactaacggacctaaccgtaacttccgttacggttcctttacgttaaccg

SEQ ID NO: 324477 - DNA, 578 bp, Homo sapiens
  misc_feature: GZ8MTXP02GEUB1.2.10.A10.1.454.CMB.2.raw
  modified_base (225)..(225): a, c, t, g, unknown or other
  misc_feature (225)..(225): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
  modified_base (327)..(327): a, c, t, g, unknown or other
  misc_feature (327)..(327): n is a, c, g, or t
  modified_base (374)..(374): a, c, t, g, unknown or other
  misc_feature (374)..(374): n is a, c, g, or t
  modified_base (430)..(430): a, c, t, g, unknown or other
  misc_feature (430)..(430): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttanacagctaccaaacaaaagactacttaggtgtaccagcagaaccnggcagcctctaagctgctcattaccgnggacatcctacccgggatcgtcggggtcccngaccgattccgagtcgcagcgggtctgggcagatttcactctcaccntcacacctgacaggctagaagatggtcgtaccgtttataccgtgtcagtcaaattnttatcggtactccgtcgtggtaccgttcggaccgtaaagggaccgtaaagggttacggaaaacttaccgaaaacggtaaaccgttggtacggtacgtaacggacccaacccgttaacttaccgttacggtttcctttacgttaacccg

SEQ ID NO: 324478 - DNA, 546 bp, Homo sapiens
  misc_feature: GZ8MTXP02FO4OK.2.10.A10.1.454.CMB.2.raw
  modified_base (232)..(232): a, c, t, g, unknown or other
  misc_feature (232)..(232): n is a, c, g, or t
  modified_base (422)..(422): a, c, t, g, unknown or other
  misc_feature (422)..(422): n is a, c, g, or t
  modified_base (457)..(457): a, c, t, g, unknown or other
  misc_feature (457)..(457): n is a, c, g, or t
  modified_base (520)..(520): a, c, t, g, unknown or other
  misc_feature (520)..(520): n is a, c, g, or t
  modified_base (525)..(525): a, c, t, g, unknown or other
  misc_feature (525)..(525): n is a, c, g, or t
tcagacgctcgacacacgaccggtgctcgatttagcgtcgatctcaggggacaacaggcaggcaggggctagcaagatggtgttgcagacccgaggtcttcatttcctctgttgctctggatctctggtgcctacggggacatcgtgatgacccagtctccagactccctggctgtgtctctgggcgagagggccaccatcaactcgacaacgtccagccagagttgtttanacagctaccaaacaaaagaactactaggtagtaccagcagaaacgaggacagcctactaagctgctcattacctggcactcctaacccgggaatcgtcggggtccctgaccgtattcccgagtcggcaggcggtacgtgggacagtattcacgtctacaccactaccaccaaacctgacaggctagaagntgtgtaccgtttattactgtacagactaatattanacgtactcctcgtaggtactacggaccaaagggaccaggtagaaactacgaaaacgacgtagngtacngaccacatcgtcgtctctacg

SEQ ID NO: 324479 - DNA, 532 bp, Homo sapiens
  misc_feature: GZ8MTXP02IXV13.2.10.A10.1.454.CMB.2.raw
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacagctaccaaacaaaagaactacttaggttgaccagacaagaaccaggcagcctacctaagctgctcattacctggcatcctacccgggatcgtcggggtccctggaccgtattccagtggcaggtcgggtcgtgggacagtactttccactcctcaaccataccaccaacctgcagctagagatgtgtccgtttattactgtcagtcaaattatatgtactccgtcgtggtacgttcgacgaaggaccaagggtagaaactacaaacgtactgtaggactcgacactatctacgtcttactac

SEQ ID NO: 324480 - DNA, 636 bp, Homo sapiens
  misc_feature: GZ8MTXP02HLFW5.2.10.A10.1.454.CMB.2.raw
  modified_base (365)..(365): a, c, t, g, unknown or other
  misc_feature (365)..(365): n is a, c, g, or t
  modified_base (386)..(386): a, c, t, g, unknown or other
  misc_feature (386)..(386): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttatacagctaccaaacaaaagaactacttaggtgtaccagcaagaaccaggcagcctcaagctgctcattaccgtggcatccgtacccgggaatcgtcggggtccctgaccgtattccgagtggcaggtcgggtctgggacngtactttcgacttctacaccntaccaccaacctgacaggctagaagataggtcggtaccgtttaattaccgtgtacagtactaaattagttaagttcggttaccctcccgttaccggttacgggtacccgtttccgggaacccgtaaaacggggtaacccgtaaaagggggttaacggtaaaacgttaccgaaaaaccggtaaccgttcgggttacggaccttaacggaccctaacccgtacttccgttcgttaccctttacgttaacccg

SEQ ID NO: 324481 - DNA, 582 bp, Homo sapiens
  misc_feature: GZ8MTXP02JWM68.2.10.A10.1.454.CMB.2.raw
  modified_base (225)..(225): a, c, t, g, unknown or other
  misc_feature (225)..(225): n is a, c, g, or t
  modified_base (358)..(358): a, c, t, g, unknown or other
  misc_feature (358)..(358): n is a, c, g, or t
  modified_base (377)..(377): a, c, t, g, unknown or other
  misc_feature (377)..(377): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaaacaaaagactacttaggtgtaccagcagaaaccaggcagcctactaagctgctcattacctggcatccgtacccgggaatccgtggggtccctggaccgtattccgagtggcaggcgggtcngggacagtactttcactcncaccatccaacccaacctgaccagggcctaggaacgtagtggtcgggtacctttattaccgtgttacagtactaaattattaatcggttaccctccgtaccggtggtaccgtttcggacgtaaacgggaccctaaagggtaggaaaactaccgaaaacgtactcggtacggctcggaccacgtacgtctacggttccttacgtac

SEQ ID NO: 324482 - DNA, 608 bp, Homo sapiens
  misc_feature: GZ8MTXP02GZRDJ.2.10.A10.1.454.CMB.2.raw
  modified_base (227)..(227): a, c, t, g, unknown or other
  misc_feature (227)..(227): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaaacaaaagaactacttaggtggtaccagcagaaaccagggcagcctcctaagctgctcattacctggcatctacccgggaatcgtcggggtcccctggaccgtattcccgagtcggacaggtcggggtctggggaccaggtactttccactcctcaccatccaaccaacctgaccaggctagaacgtatggtacggtccgtttattacgtggtacaagtactaaattatttagtcggttacctcccgttccggtaggtaccgttccgggacccgtaaacgggggtacccgtaaaaggggtaggaaaactaccgaaaacggtacgtggtaggacctggaccaaccgtacttcctacgttccttacgtaaccg

SEQ ID NO: 324483 - DNA, 573 bp, Homo sapiens
  misc_feature: GZ8MTXP02G0M46.2.10.A10.1.454.CMB.2.raw
  modified_base (225)..(225): a, c, t, g, unknown or other
  misc_feature (225)..(225): n is a, c, g, or t
  modified_base (270)..(270): a, c, t, g, unknown or other
  misc_feature (270)..(270): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaaacaaaagactacttaggtgtaccagcaagaaccnggcagcctctaagctgctcattacctggcatccgtacccgggatcgtcggggtccctgaccgtatcccgagtggcaggtcggggtctggggaccaggtactttcgacttcctacacctactaccaaccctaaacctgacaggtcctagaacgtatggtcggtaccgtttaattactgtacagactaattattagtcgtacctccgttcgtcggtaccgttcgacgaacggggtaacctaagggtacgaaactacgaaacgtacgtcggtacgcgtaagccaaccgatacgtcgttactctacc

SEQ ID NO: 324484 - DNA, 538 bp, Homo sapiens
  misc_feature: GZ8MTXP02FOFQL.2.10.A10.1.454.CMB.2.raw
  modified_base (225)..(225): a, c, t, g, unknown or other
  misc_feature (225)..(225): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaaacaaaagactacttaggtgtaccagcagaaaccaggcagcctacctaagctagctcattaccgtggcatccgtaacccgggaatcgtcggggtcccctgacccgtattccgagtggcaggcgggtctgggcagtatttcactctcaccatcaccacctgacaggctagaagtatgtgtaccgtttatactgtacagtcaattattatggtacctcgtacgtggacgttcggacgaacgggacctaagggtagaaactacgaaaacgacgtagtggactgacaccgtatctacgtcctactac

SEQ ID NO: 324485 - DNA, 522 bp, Homo sapiens
  misc_feature: GZ8MTXP02F9GBJ.2.10.A10.1.454.CMB.2.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (270)..(270): a, c, t, g, unknown or other
  misc_feature (270)..(270): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaaanaaaagaactacttaggtgaccagcagaaaccnggcagcctcctaagctgctcattacctggcatcctaacccgggatcgtcggggtccctgaccgattccagtgcaggcggtctggggcagactttcactctcaccatccaccaaccctgacaggctagaagatggtcggtacctttattactgtcagcaattattatcggtactctcggtgtacgttcggccaaggaccaaaggtgaaaactacgaaaacgtactaggtggctgcaaccatcgtctctactac

SEQ ID NO: 324486 - DNA, 551 bp, Homo sapiens
  misc_feature: GZ8MTXP02FYB8O.2.10.A10.1.454.CMB.2.raw
  modified_base (225)..(225): a, c, t, g, unknown or other
  misc_feature (225)..(225): n is a, c, g, or t
  modified_base (296)..(296): a, c, t, g, unknown or other
  misc_feature (296)..(296): n is a, c, g, or t
  modified_base (416)..(416): a, c, t, g, unknown or other
  misc_feature (416)..(416): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgttttanacagctaccaaacaaaagaactacttaggtgtaccagcagaaccaggcagcctactaagctgctcattacnggcactctacccgggatcgtcggggtcctgaccgtattccagtgcaggcggtcgtgggcagatttcactctcaccatccaccaacctgacgtagctagagatggtgtaccgttatacgtntcagtcaattattatcggtacctccgtcgtacggtacgttacggaccgtaagggaaccgtaagggtacggaaactacgaaaacgtaacgtgtacggacgtaagaccgtaacctactcgttacgttactactaccc

SEQ ID NO: 324487 - DNA, 653 bp, Homo sapiens
  misc_feature: GZ8MTXP02HU8YY.2.10.A10.1.454.CMB.2.raw
  modified_base (228)..(228): a, c, t, g, unknown or other
  misc_feature (228)..(228): n is a, c, g, or t
  modified_base (299)..(299): a, c, t, g, unknown or other
  misc_feature (299)..(299): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagttgtttanacagctacaaacaaaagactactaggtgaccagcaagaaaccaggcagcctacaagctgctacattaccgnggctactccgtacccgggaatccgtcggggtcccctggaccgtattcccgagtcggcaggcgggtctaggggactagtactttcgacctctacaccatccaaccaactgacaggctagaagtagtcggttacggtaccgtttaattacgtcgtacgaacgtactaaaattagtttaacgttacggttaacccttcccgttaccgggtacggtaacccggtttccgggaacccgtaaaacgggggtaaccgtaaaggggttacggaaaaacttaccggaaaaaaccggtacgttacggtacggaccgtaacggaccaacccttagttccgtttacggttactttaccgtaacccg

SEQ ID NO: 324488 - DNA, 616 bp, Homo sapiens
  misc_feature: GZ8MTXP02JLRNX.2.10.A10.1.454.CMB.2.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (278)..(278): a, c, t, g, unknown or other
  misc_feature (278)..(278): n is a, c, g, or t
  modified_base (329)..(329): a, c, t, g, unknown or other
  misc_feature (329)..(329): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaanaaaagactactaggtgacagcagaacaggcagcctacaagntgctcattaccgtggcatccgtacccgggatcgtcggggtccctgaccgtntccgagtgcaggcggtctgggcagtattcacgtctacaccataccaccaacctgacaggactagaacgagttgtcggtaccgtttaatacgtgttacacgactaaattagttaacgtacggtaaccttcccgtacccggtagggtaacccggtttaccgggaaccgtaaaacgggggtaaccctaaaagggggttacggaaaaacgtaccgtaaaaccggtaacgttcggttacgggacctaaggaccctaacccgtagttccgttcggttacctttacctaacccg

SEQ ID NO: 324489 - DNA, 693 bp, Homo sapiens
  misc_feature: GZ8MTXP02HSL9V.2.10.A10.1.454.CMB.2.raw
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttatacagcctaccaaaacaaaaaagtactaacgttaggttacgtaaccagacaaacgaaaccgaggacacgccctacgtaacgctcgcctactaacttaccggtgggacctaacgttaccccggtaaacccgggtaacgttccgggttccggggtacccctacggacccgttacttccgaagggttcggacgacgggtccgggttcggtagggaccgtaggttacttccaccttcctaccacctactacccaaaccctaaccgtgaccgaggtactagaaacgtgttcgggtcggttacctttatacgtgtacgtacgtaataaatttagttacggtacggtacccttccgtacgggttacggtaccggttaccggacgaaacggtacgaagggttaacgaaactacgaaaacgtacgtggtcgtacgtaacgcctaaaccgttcttacgttacgttaccttacgtaccg

SEQ ID NO: 324490 - DNA, 696 bp, Homo sapiens
  misc_feature: GZ8MTXP02FSK4S.2.10.A10.1.454.CMB.2.raw
  modified_base (226)..(226): a, c, t, g, unknown or other
  misc_feature (226)..(226): n is a, c, g, or t
  modified_base (271)..(271): a, c, t, g, unknown or other
  misc_feature (271)..(271): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacagctaccaaacaaaagactacttaggtgtaccagacagaaccnggcagcctctaagctgctcattaccgtggactagtccgtacccgggatccggtcggggtccctggacccgtattcccgaggtcggacgagggtccggggttcgtggggactagtactttaccgaccgttcctaccaaaccctattacccaaaccctaaacccgtggaccgtaagggtccttaagggaaagtacgttcggttacgggttacccttttaagttaccgttgtaccgtaaggtacctaaaatttacgtttaacgtccgggttaaccttcccgttacgggttacgggtaaccggtttaccgggaaccggtaaaacggggtaacccgtaaaaggggttacggtaaaactaccggaaaaaccggtacgttacgtacgggactaacggaccctaaccgtattccgtagttaccttactaaccg

SEQ ID NO: 324491 - DNA, 591 bp, Homo sapiens
  misc_feature: GZ8MTXP02FNA9V.2.10.A10.1.454.CMB.2.raw
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
  modified_base (333)..(333): a, c, t, g, unknown or other
  misc_feature (333)..(333): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgagaggccaccatcaactgcaagtccagccagagttgtttanacagctaccaaacaaaagaactacttaggtggtaccagacaagaaaccaggcagcctactaagctgctcattaccgnggcatccgtacccgggatcgtcgggtcccngaccgtattccgagtgcaggcggtctgggacagtactttcgactctacacctatccaaccaactgacaggctagagtagtggtagtaccgtttattactggtacagtactaaattagttacgtcggtacctccggtcggtaggaccggttaccggaaccgtaaacgggaaccgtaaaagggtacggaaaacgttacaaaacggtacgttacggtcggtacgtaacgaccaaccctagttccttcgtaccttactaccc

SEQ ID NO: 324492 - DNA, 555 bp, Homo sapiens
  misc_feature: GZ8MTXP02GYE01.2.10.A10.1.454.CMB.2.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagacctccctggctgtgtctcgtgggcgaggaggccaccatcaactgcaagtccagccagagttgtttanacagctaccaaanaaaagactacgttaggtgaccagacaagaaccaggcagcctactaagctagctcacttaccgnggcactccgtacccgggaatccgtacggggtccctagaccgtntccgagtggcaggcggtcgagggcagtattcgactctacacatccaccaacctgcaggctagagatgtcgtcgtttatactgtacagtactaattagttagtacgttacctccgttcggtaggtaccgtcggaccgaaagggtaccaagggtagaaaactacgaaaacgtactggtcgacaacgacacctatcctcgttctactaccg

SEQ ID NO: 324493 - DNA, 559 bp, Homo sapiens
  misc_feature: GZ8MTXP02JBA1E.2.10.A10.1.454.CMB.2.raw
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttanacagctaccaaanaaaagactacttaggtgtaccagacaagaaccaggcagcctactaagctgctcattaccgtggcatccgtaacccgggatcgtcgggtccctgaccgtattccgagtgcaggcggtntgggcagtacttcactcncaccatccacaacctgcagctagagtatcgtgtacctttatactgtacagtactaattattagtcggttacctccgtacgtggaccgttcgacgaacgggtaccaaagggttgaaaactaccgaaaacggtaccttagggtcgtacgtcgaccgtacctagttctcggttaaccttcgtacccg

SEQ ID NO: 324494 - DNA, 539 bp, Homo sapiens
  misc_feature: GZ8MTXP02JE7E3.2.10.A10.1.454.CMB.2.raw
  modified_base (225)..(225): a, c, t, g, unknown or other
  misc_feature (225)..(225): n is a, c, g, or t
  modified_base (296)..(296): a, c, t, g, unknown or other
  misc_feature (296)..(296): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaaacaaaagaactacttaggtgtaccagcagaaccaggcagcctcctaagctgctcataccnggcatctacccgggatcgtcggggtccctgaccgattccagtggcagcgggtctgggcagatttcactctcaccatcaccacctgcaggctagagatgtgtaccgtttattactgtcagtactaattattatcggttacctccgtccggtggaccgttcggaccgaacgggaccaagggtaggaaaactacgaaaacgtacgtaggtcggactaaggacaacgtactcgtcgtccttactacc

SEQ ID NO: 324495 - DNA, 614 bp, Homo sapiens
  misc_feature: GZ8MTXP02ICFN3.2.10.A10.1.454.CMB.2.raw
  modified_base (226)..(226): a, c, t, g, unknown or other
  misc_feature (226)..(226): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgaggaggccaccatcaactgcaagtccagccagagtgtttanacagctaccaaacaaaagactacgttaggtgtaccagcaagaaccaggcacgcctacctaagctgctacattacctgggcacgtcgtaacccgggatccgtcggggtccctgaccgtattccgaggtcggcgaggcggggtctggggacctagtactttcaccgtctacaaccactacccaaccaacctgcagggctagaagtatggtcgtaccgtttattactcgtacacgtactaaattattaacgtcggttaacctcccgttaccggtagggtaccgtttaccggaccgtaaaaggggtaaccgaaagggttaacggaaaacttaaacgaaacggtacgtacggtcggactcggacctaacctattcctacgttccttacgtacc

SEQ ID NO: 324496 - DNA, 643 bp, Homo sapiens
  misc_feature: GZ8MTXP02FVVW5.2.10.A10.1.454.CMB.2.raw
  modified_base (228)..(228): a, c, t, g, unknown or other
  misc_feature (228)..(228): n is a, c, g, or t
  modified_base (311)..(311): a, c, t, g, unknown or other
  misc_feature (311)..(311): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttaanacagactaacaaaacaaaagactagttaggtagacagacaacgaaaccgaggcacgcctactaagctagctactacttaccgnggactactaccgtaacccgggtatccggtcgggtccctaggaaccgtattccgaggtcggacgacgggtcgggtacgtagggactagtactttaccaccttcctacaacctaactacccaaacccctaaaccgtgacgaggactaaggaagtagttcggttacggtaccttttaattacgtagtacaagtacttaaattaattagtaccgttactcccgttcggtacgtaccggttacggaaaccgaaaggaacgtaagggtaacgaaaactaacgaaaacgtacgtggtacgactaacgaccctaactacgtcttacgtaccttactaacg

SEQ ID NO: 324497 - DNA, 603 bp, Homo sapiens
  misc_feature: GZ8MTXP02IO1E1.2.10.A10.1.454.CMB.2.raw
  modified_base (232)..(232): a, c, t, g, unknown or other
  misc_feature (232)..(232): n is a, c, g, or t
  modified_base (319)..(319): a, c, t, g, unknown or other
  misc_feature (319)..(319): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagacctcctggctgtgtctcgtgggcgaggacgggccaccatcaactgacaagtccagccagtagttgttttanacagcctaaccaaacaaaacgaacttacttaggttggtaaccagacaagaaaccgagggcacgcctcctaaagctgctcattaccgnggcatccgtacccgggatcgtcgggtccctgaccgtattcgagtgcaggcggtcgtgggcagtacttcgacttcctacacctatccaacacctgacaggctagagtatgtcggtactttatactgtacagtactaattattactcggttactccgttcggtacgggtaccgttccggacgaaacggggtaacccaaagggttagaaactaaacggaaaacgtacgtacggttcggacttaacggaccctaaaccgtacgttacgttcgttacctttacctaccg

SEQ ID NO: 324498 - DNA, 628 bp, Homo sapiens
  misc_feature: GZ8MTXP02HZ8YI.2.10.A10.1.454.CMB.2.raw
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
  modified_base (513)..(513): a, c, t, g, unknown or other
  misc_feature (513)..(513): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactcctggctgtgtctcgtggcgaggacggccaccatcaactgacaagtccagccagtagttgtttanacngtctaccaaanaaaagtctagtaggtcgacagacagaaaccgnggcagcctactaagctcgactacacttaccgnggactacgtccgtaacccgggaattccggtaggggtcccctaggaccgtattcccgaggttcggcaggggtcggtcgtaggggacctaggttactttaccacgttactaccgaactagtacccacctaaccgtgacacggtctaagagtcttagggtacgttcctttaaagtccgtagctaagtactaattacgtagtcgttaaccnccgttacggtgtaccggttcgaacggtaaaggaccgtaaggttacgaaaactccggaaaacgtcgttacgggtccgacgtcgacctaccgtacttcgtaccgttctttaacgccc

SEQ ID NO: 324499 - DNA, 592 bp, Homo sapiens
  misc_feature: GZ8MTXP02JQLDE.2.10.A10.1.454.CMB.2.raw
  modified_base (315)..(315): a, c, t, g, unknown or other
  misc_feature (315)..(315): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
  modified_base (422)..(422): a, c, t, g, unknown or other
  misc_feature (422)..(422): n is a, c, g, or t
  modified_base (443)..(443): a, c, t, g, unknown or other
  misc_feature (443)..(443): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatacaactgacaagtccagccagagttgtttatacagctaccaaacaaaagaacttacttaggttcggtaccagacaagaaaccagggacagcctactaagctgctacacttaccgnggcacgtccgtacccgggtatcgtcgggtcctgaccgtntccgagtgcaggcggtcngggcagtattcgactcctcactatccaaccactgacagtcctagaacgtntgtggtcctttatacgtgtanagtactattattagtcggtacttccgtcgttaggacgttaccggacgtaacgggtaccaagggtacgaaaacgtaaccgaaacgtaacgtcggtacggacgttaacggaccctaaccgtacgttccgtacggtttacctacttaacccg

SEQ ID NO: 324500 - DNA, 744 bp, Homo sapiens
  misc_feature: GZ8MTXP02IOBQ4.2.10.A10.1.454.CMB.2.raw
  modified_base (228)..(228): a, c, t, g, unknown or other
  misc_feature (228)..(228): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagagttgtttanacagctaccaaacaaaagtaactacgttaggttaggtaccagcaagaaaccagggacacgcctacctaaagcctgctacacttaccgtgggcagtccgtacccgggaattcgtacggggtccctggaccgtacttaccgaggtcgcgagggtccgggtcgtacggggacctaggtactttcccgaccttccgtaccaaaccctaacttcccaaacccaaacccgtgacccgaacggtaccttaggaaaacgtcgttagggtaccggttacccgtttaatttaccgtcgttaccgaagtaccgtaaaatttagtttaaacgtcgggtttaaccccttccggttacccgggttacgggtaacccgggttttaccgggaacccgggtaaaaccgggggtaaaaccgtaaacgggggtaaacggtaaaacctaaaccggtaaaacggtaaccgtacgggtacggtacgttaaccggaccgtaacctacgttccctttacggttcctttaccttaaccccg

SEQ ID NO: 324501 - DNA, 652 bp, Homo sapiens
  misc_feature: GZ8MTXP02FN8EF.2.10.A10.1.454.CMB.2.raw
  modified_base (229)..(229): a, c, t, g, unknown or other
  misc_feature (229)..(229): n is a, c, g, or t
  modified_base (351)..(351): a, c, t, g, unknown or other
  misc_feature (351)..(351): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccagagttgtttanacagctaccaaacaaaagactacgttaggtagtaccagacaagaaccgaggcagcctacgtaagctgctcacttaccgtggacacgtccgtaacccgggatccggtcgggtccctgaccgtnttcccgagtcggcaggtccgggtcgtacggggcaggtactttccgactccgtaacacctactaccaaccctaaaccgtgacgaggcctagaacgtagtcgggtacgttacccgtttattacgtgtacaacgtactaattagttacgtaccggttaccttaccgttccgggtagggtaaccgttaccgggaacccgtaaaacggggaccggtaaagggtaaacggtaaaactaacccgtaaaacggtacgttagggtaccgactaacggaaccctacgtacttctcgttacttccgtaaccg

SEQ ID NO: 324502 - DNA, 653 bp, Homo sapiens
  misc_feature: GZ8MTXP02I1HE6.2.10.A10.1.454.CMB.2.raw
  modified_base (227)..(227): a, c, t, g, unknown or other
  misc_feature (227)..(227): n is a, c, g, or t
  modified_base (429)..(429): a, c, t, g, unknown or other
  misc_feature (429)..(429): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttaanacagactacaaacaaaataactagttaggtacgacagacaagaacgaggacacgacctacctaagctcgactactacttaccgtggactacgtaccggtaacccgggtatccggtccgggtacctacggaaccgtatccgagtcggacgtacggtcggtacgagggactagtacttaccactctacacactaccacctaacngacgaggctagaagtagtacggttacgttacgtttaattacgtacgtacaactaataaagttacttaacgtacggttaccttaccgtacggtacggtaccggttaccgggaaccgtaaaacgggtaaccggtaaaagggtaaacggaaaacgtaaacgtaaaacgtaacgtacggtacggtactaacgacctaacctacgttaccgtacgttacctttactacg

SEQ ID NO: 324503 - DNA, 731 bp, Homo sapiens
  misc_feature: GZ8MTXP02HMHUK.2.10.A10.1.454.CMB.2.raw
  modified_base (236)..(236): a, c, t, g, unknown or other
  misc_feature (236)..(236): n is a, c, g, or t
  modified_base (326)..(326): a, c, t, g, unknown or other
  misc_feature (326)..(326): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatcaactgacaacgtccagccaagtagttgttttaanacagcctaccaaaacaaaaagtaactacgttaggttacgtaaccagacaagaaaccgagggcacgcctactaagctcgctctattaccgngggactactaccgtaacccgggtaatccggttcggggtcccctaggaccccgtattccccgaggtcgcgacgggtcgggtcgtaggggactaggttactttaccaccgttctaccacctactacccaaccctaaacccgtgaccgaggtcctaaggaaagtgttcggtacggttacccgtttaattaccggttagtacctaaggtacctaaagtttagtttaacgtcggttaccctccggttaccggtacgggtaccgtttcccggggaacccggtaaaacggggtaacccggtaaaaggggttaacggtaaaactaaaccggtaaaaaccgtaccgttagggttaccgggacttaacggaacctaaccggttaacttccgtacggttcctttaacctttacccg

SEQ ID NO: 324504 - DNA, 607 bp, Homo sapiens
  misc_feature: GZ8MTXP02JGPID.2.10.A10.1.454.CMB.2.raw
  modified_base (225)..(225): a, c, t, g, unknown or other
  misc_feature (225)..(225): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctaccaaacaaaagactacttaggttgtaccagcaagaaaccaggcagcctcctaagctgctcattacctggcatccgtacccgggaatcgtcgggtccctgaccgattccgagtggcaggcggtctgggcagtactttcacgttcctacacctactacccaaccctaaacccgtgaccgacggtcctaggaaagtaagttcggttgggtacccgttttattaccgtgttaccaaggtacctaaaattagtttatacggttacctcccgttccggtaggtaccggttccgggacccgtaaaggggaacccgtaagggtacggaaaactaccgaaaacgtaacgtggtacgctaacgcaaccgtatcgtacgtctctac

SEQ ID NO: 324505 - DNA, 660 bp, Homo sapiens
  misc_feature: GZ8MTXP02JWOZI.2.10.A10.1.454.CMB.2.raw
  modified_base (228)..(228): a, c, t, g, unknown or other
  misc_feature (228)..(228): n is a, c, g, or t
  modified_base (283)..(283): a, c, t, g, unknown or other
  misc_feature (283)..(283): n is a, c, g, or t
  modified_base (316)..(316): a, c, t, g, unknown or other
  misc_feature (316)..(316): n is a, c, g, or t
  modified_base (638)..(638): a, c, t, g, unknown or other
  misc_feature (638)..(638): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatcgacccagtctccagacctccctggctgtgtctcgtggcgagacggccacatcaactgacaagtccagccagagttgtttanacagacctaccaaaacaaaagactacgttaggtcgaaccagacaaacgaaaccgngggccacgccctacaagctcgctacattaccgnggactatccgtaacccgggatcggtcgggtccctagaccgtatccgaggtcggacgacgggtccgggtcgaggggtacctagtactttcccactccctaccaacctactaccctaacccaaacctcggaccgtaacggctaggaaagtgttacgggtcggttacctttaataccgtgtacgagaactaattagttagtccggttaacctccgttaccgggtacggtaccggttaccggaaccggtaaaacggggtaacctaaggggtaacgtaaaacgtaaaccgtaaaacggtaccgtggtacggactaagccctaaaccngttcttacgtccttactacccg

SEQ ID NO: 324506 - DNA, 702 bp, Homo sapiens
  misc_feature: GZ8MTXP02GFVL2.2.10.A10.1.454.CMB.2.raw
  modified_base (227)..(227): a, c, t, g, unknown or other
  misc_feature (227)..(227): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaaaacaaaagaactacttaggtcgaccagacaagaaaccaggcacgccctacctaaagctcgactctaacttaccgtggactacgtacccgtaacccggggaatccggttccggggtcccctaggaccgtattcccgaaggtcggcaagggtccggggtactaggggacctaggtacttttaccgaaccttcctaccaacctaaacttaccccaaaccctaaaccctcggaccaaagggtccgttaaggaaaagtaccggttgggttcgggttaacccttttaagttaaacccgttggtaccgaacgtactaaactttaagttagtaccggttaacccttcccggtacccgggtagggtacccggttaccgggaacccgaaaagggaccgtaaaagggtaggaaaaactaccgaaaacggtacttaggcggtacaacgaccacctatccgtacgtccttaactccc

SEQ ID NO: 324507 - DNA, 600 bp, Homo sapiens
  misc_feature: GZ8MTXP02JJ1V8.2.10.A10.1.454.CMB.2.raw
  modified_base (234)..(234): a, c, t, g, unknown or other
  misc_feature (234)..(234): n is a, c, g, or t
  modified_base (363)..(363): a, c, t, g, unknown or other
  misc_feature (363)..(363): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggcccaccatcaactgaccaagtccagccagtagttgtttanacagcctaccaaacaaaagaactacgttaggtacggtaccagacaaacgaaaccgagggcacgcctacctaagctgactctactaccgtggctatccgtaacccgggatcggtcgggtccctgaccgtnttccgagtgcgagggcggtacgtgggacagtactttcacctctaccacctactacccaaccctaaccgcgacgacggtcagaagtagttgtcggtaccgtttatacgtgtacagtactaaattattactcggtactcccgtcggtcggaccgttaccggacgaaggaaccgtaaggtacgtaaacacgaaacgtacgtcggaggactcgacaacgtctacgtacgttcctactaccc

SEQ ID NO: 324508 - DNA, 604 bp, Homo sapiens
  misc_feature: GZ8MTXP02HPD31.2.10.A10.1.454.CMB.2.raw
  modified_base (226)..(226): a, c, t, g, unknown or other
  misc_feature (226)..(226): n is a, c, g, or t
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgagaggccaccatcaactgcaagtccagccagagtgctttanacagctaccaaacaaaaagactacttaggtggtaccagacaagaaaccgaggacacgcctacctaagctgctacattaccgnggcactcgtaacccggatcgtcggggtcccngaccgtatcgagtgcgaggcgggtctggggacagtacttcactcncacatccaccacngcagctagatntgtacgtcctttatacgtgtcagtactaagttattagtcggttactcccgtacggtaggtaccggttccgggaacccgtaaaacggggtacccgtaaaggggtaaccggtaaaacgtaccgtaaaaacccggtaacgttgggtaccggtaaccttacggaccctaccgtaactttccgtacgttttccttaacccg

SEQ ID NO: 324509 - DNA, 566 bp, Homo sapiens
  misc_feature: GZ8MTXP02IC9DR.2.10.A10.1.454.CMB.2.raw
  modified_base (228)..(228): a, c, t, g, unknown or other
  misc_feature (228)..(228): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagtagtgtttanacagctaccaaacaaaagtaactacttaggttgaccagcaagaaaccaggcagcctactaagctgctcattaccgtggcatctaacccgggatcgtgggtcccctgaccgtatccgagtcggcaggcgggtctgggcagtacttcgactcctacacactccaccaactgcaggctagaagtatggtcgtaccgtttattacctgtacagtactaattagttagtacgtaccttcgtcggtaggtaccgttacggaccgaaagggtaccaaagggtaggaaactacgaaaacgtactggtagacgtaacgaccacgtacgtccgtacgtaccttactac

SEQ ID NO: 324510 - DNA, 567 bp, Homo sapiens
  misc_feature: GZ8MTXP02FLV3B.2.10.A10.1.454.CMB.2.raw
  modified_base (298)..(298): a, c, t, g, unknown or other
  misc_feature (298)..(298): n is a, c, g, or t
  modified_base (406)..(406): a, c, t, g, unknown or other
  misc_feature (406)..(406): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacagctaccaaacaaaaagaactacttaggtgaccagcagaaccaggcagcctacaagctgctcattaccnggcatccgtaacccgggaatcgtcggggtccctgaccgtattcccgagtggcaggcgggtctggggacagatttcactctcaccatccaccaacctgcaggctgaagntgtggtacctttatactgtacagactaattacttagtcggtactccgtcgtaggtaccgttcggacgaaacgggacctaaaggtacggaaaactacgaaaacggaacgttggacggtactaacggaccaacccgtattccgttagttacccttacgtaccg

SEQ ID NO: 324511 - DNA, 543 bp, Homo sapiens
  misc_feature: GZ8MTXP02F8TX1.2.10.A10.1.454.CMB.2.raw
  modified_base (434)..(434): a, c, t, g, unknown or other
  misc_feature (434)..(434): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttatacagctaccaaacaaaagaactacttaggtgtacagcagaaccaggcagcctctaagctgctcattacctggcatctacccgggatcgtcggggtccctgaccgtattcccagtcggcaggcgggtctgggacagtatttcactctacaccatcaccaacctgacaggctagaagatgtggtacctttattactgtacagcaatattanaggttacctcgtccgtgacgttcggacgaaagggaccgaaaggtaggaaaactacgaaaacgtaacgtcgtaggacctaaggaccacctatccgttcttaccttactac

SEQ ID NO: 324512 - DNA, 637 bp, Homo sapiens
  misc_feature: GZ8MTXP02HD0KR.2.10.A10.1.454.CMB.2.raw
  modified_base (227)..(227): a, c, t, g, unknown or other
  misc_feature (227)..(227): n is a, c, g, or t
  modified_base (306)..(306): a, c, t, g, unknown or other
  misc_feature (306)..(306): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaaacaaaagaactacttaggtacgaccagacaacgaaaccaggcacgcctactaagctgctcattaccgnggcatcgaacccgggatccgtcgggtcctgaccgtagttccagtcggactaggcgggttacgtggggaccagttatttccgacttcctaccaacctactaccaaacccgtaaacccgtgaccgaggtacccttaagggaaacgtagtttacggttcggttaccccgttttaaattaccgttagtaccacgtactaattagttacgtgtaccctcgtcggtaggtaccggttaccggacgaaaacggggacctaaaagggtacgaaaacttaccgaaacgtaccgtgtacgattaaccgactaaccctagttcctcgtacccttactaaccg

SEQ ID NO: 324513 - DNA, 595 bp, Homo sapiens
  misc_feature: GZ8MTXP02IWO5Y.2.10.A10.1.454.CMB.2.raw
  modified_base (187)..(187): a, c, t, g, unknown or other
  misc_feature (187)..(187): n is a, c, g, or t
  modified_base (225)..(225): a, c, t, g, unknown or other
  misc_feature (225)..(225): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagnggccacatcaactgcaagtccagccagagttgttttanacagctaccaaacaaaagaacttaacttaggttggaaccagacaagaaaccaggcagcctcctaagctgctcattacctggcactccgtaacccgggatcgtcggggtccctgaccgtattcccgaggtcggcgacggtcggggttactggggactagtaacttttcaccttccacaccatccacctaaccctgaccgaggctagaagattcggtacggtacctttattactcgtacatactaattattacgtcggtactctcggtacggcgttacggactaacgggtaccaagggttacggaaacttacgaaaacgtacgtagttacggccttaaggaccctactaactcgtacgtacctttctacccg

SEQ ID NO: 324514 - DNA, 529 bp, Homo sapiens
  misc_feature: GZ8MTXP02GOIH5.2.10.A10.1.454.CMB.2.raw
  modified_base (231)..(231): a, c, t, g, unknown or other
  misc_feature (231)..(231): n is a, c, g, or t
  modified_base (301)..(301): a, c, t, g, unknown or other
  misc_feature (301)..(301): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
  modified_base (438)..(438): a, c, t, g, unknown or other
  misc_feature (438)..(438): n is a, c, g, or t
  modified_base (502)..(502): a, c, t, g, unknown or other
  misc_feature (502)..(502): n is a, c, g, or t
  modified_base (517)..(517): a, c, t, g, unknown or other
  misc_feature (517)..(517): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccgatcaactgacaagtccagccagagttgtttanacagctaccaaacaaaagactattaggtgacagcaagaaccaggcagcctactagctgctcacgttaccnggacactcgtacccgggatcgtcggggtccctgaccgtatccgagtgcaggcggtcngggacngtacttcactcncacnaccactacngcagctagagtgtgtcggtactttagtactgtacagtactaattagtancgttacctcgtcggtacggtacgttcgaacgtaggaacctaaggtacgaaactacgaaacgtancgtagctcgctactntctgtacttcac

SEQ ID NO: 324515 - DNA, 745 bp, Homo sapiens
  misc_feature: GZ8MTXP02JVTBP.2.10.A10.1.454.CMB.2.raw
  modified_base (230)..(230): a, c, t, g, unknown or other
  misc_feature (230)..(230): n is a, c, g, or t
  modified_base (316)..(316): a, c, t, g, unknown or other
  misc_feature (316)..(316): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctcgtgggcgaggacggccaccatcaactgcaagtccagccagtagttgttttanacagctaccaaacaaaaagaactaacgttaggttcgtaccagacaaagaaacccgaggcacgcctacctaagctgctcattaccgnggacctagtacccgtaacccggggaattccggtcgggggtacccctaggtacccgtagttcccgaggtcgggccgtaacgggtccggggttacgttacggggacctacggttacttttaccgaccttacctaccaaaccctacgtacccaacccctaaaacccgtgaaccgtacggtacctaaggaaagtcgttaggttaccggttaccgttttaattaccgtggtaaccagtaactaaaagttactttaacgtcggttaaccttcccggttacggtacgggtaaccggtttaccgggacgtaaaacggggtaaccgtaaaaggggtaacggtaaaacgttaaccgaaaacggttaacgtcgggtacggttaaccgcgtaacccttaaccgttactttcccttttaaccgttaccttactttacccccg

SEQ ID NO: 324516 - DNA, 705 bp, Homo sapiens
  misc_feature: GZ8MTXP02FXJ0H.2.10.A10.1.454.CMB.2.raw
  modified_base (207)..(207): a, c, t, g, unknown or other
  misc_feature (207)..(207): n is a, c, g, or t
  modified_base (534)..(534): a, c, t, g, unknown or other
  misc_feature (534)..(534): n is a, c, g, or t
  modified_base (550)..(550): a, c, t, g, unknown or other
  misc_feature (550)..(550): n is a, c, g, or t
  modified_base (668)..(668): a, c, t, g, unknown or other
  misc_feature (668)..(668): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgccgtacggggacatcgtgatcgacccagtctccagacctccctggctgtgtctcgtgggcgagacggccacatacaactnacaacgtccacgccaaggtagtttagttttaactacgacgtacctaaccaaaaactaaaaaacgtaaacgtttaacgtttaacggggttacggtaacccgtaacgaacgaaaacggaaaacccggaggggaccaacggtacccctaaccggtaaacgccttcggaccttacgtaacttaccggtgggacctaagtacccggtaaccccggggtatccgggttaccgggtcccgtaggtaacccgtagttcccgaaggtcggacgtacgggtccggggtcgtacggggactagtacttcacgtcctacacactccaaccgtaacctgngacgtcgtaaagagtntacggtcgttaccttattactgtcaagttactaattacttagtcgtaccttccgtacggcggttacgacggtaccgaaaggtaaccgaaggtaacgaaactaacgaaacgtcgtacgngtacgaacgctaacgtactcgttactaccttctaccg

SEQ ID NO: 324517 - DNA, 516 bp, Homo sapiens
  misc_feature: GZ8MTXP02HXAXC.2.10.A10.1.454.CMB.2.raw
  modified_base (229)..(229): a, c, t, g, unknown or other
  misc_feature (229)..(229): n is a, c, g, or t
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
tcagacgctcgacacacgaccggtgctcgatttagcgtcgatctcaggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaaagtccagccagagttgttttaanacagctaccaaacaaaaagaactacttaggttggtaccagcaagaaacaggcagcctactaaagctagctcattacctggcatctaccggatcgtggcctgacntcagtgcagcggtacgngggcagattcactncacancacacctgcagctganatgtgacgttattactgtcaagtactaattatagtgtactaccgtcgtggaacgttcggaccaaagggtacaaagggtcggaaaatacgaaacgtacgtaagtcgatcgacacactctacgttctactacg

SEQ ID NO: 324518 - DNA, 527 bp, Homo sapiens
  misc_feature: GZ8MTXP01C2BZD.8.71.G05.1.454.CMB.2.raw
  modified_base (505)..(505): a, c, t, g, unknown or other
  misc_feature (505)..(505): n is a, c, g, or t
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactattaaattggtatcaacaaaaccaggaaagccctaaatacctggtctatactgcatccactttgcaaagtggggtacccatcaaggttcagtggcagtggatttgggactagttttcactctcacaatcagcagtctcgaacctgaagtattttgacaatttactactgtacaacagacttacaatactaccgagacgttcggtacaagggaccaaaggtgaaggatacaaacgaactgttggcttgcaccattccttagtcttnaattcttccgcctaattctaag

SEQ ID NO: 324519 - DNA, 516 bp, Homo sapiens
  misc_feature: GZ8MTXP01A092Z.8.71.G05.1.454.CMB.2.raw
  modified_base (222)..(222): a, c, t, g, unknown or other
  misc_feature (222)..(222): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgaccccagtctccctcctctctgtctgcttctgtgggagacagcgtcaccatcacttgccggnagtcagtccattaacaactattaaatgtatcaacaaaacaggaaagccctaaatacctggtctatactgcatccactttgcaaagtggggtcccatcaaggttcagtggcagtggatttggggactagttttcactctcacaatcagcagtctcgaacctgaagtattttgactaacttactactgtacaacagacttacaatataccgagacgttcgtacaaggaccaaggtgagatcaaacgaactgttggcttgcacattcttgtctcaactcttccgcctaattcgtaag

SEQ ID NO: 324520 - DNA, 511 bp, Homo sapiens
  misc_feature: GZ8MTXP01AP4CQ.8.71.G05.1.454.CMB.2.raw
  modified_base (195)..(195): a, c, t, g, unknown or other
  misc_feature (195)..(195): n is a, c, g, or t
  modified_base (472)..(472): a, c, t, g, unknown or other
  misc_feature (472)..(472): n is a, c, g, or t
  modified_base (483)..(483): a, c, t, g, unknown or other
  misc_feature (483)..(483): n is a, c, g, or t
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcaccatcacttgccggcagtcagtccattaacaactattaaattggtatcaacaaaaccagggaaagcccctaaatacctggtctatactgcatccactttgcaaagtggggtcccatcaaggttcagtggcagtggatttgggacagttttcactctcacaatcagcagtctcgaacctgaagtattttgactaaacttactactgtcaacagacttacaatataccgagacgttggtcaagggaccaaggtggagatcaaagaactgnggcttgcaacngttcttgtctcaattctcttcgccaatc

SEQ ID NO: 324521 - DNA, 528 bp, Homo sapiens
  misc_feature: GZ8MTXP01CX3RF.8.71.G05.1.454.CMB.2.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
  modified_base (480)..(480): a, c, t, g, unknown or other
  misc_feature (480)..(480): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcagtcagtccattaacaacttattaaattggtatacaaacaaaaccaggaaacnccctaaatacctgtctatactgcatccactttgacaaagtcgggtacccatcaaggttcagtgcagtggattgggactagtttcactctcaacaatcagcagtctacgaacctgaagtatttgactaactttactactgtacaacagtacttaacaatactaccgagacgttcgtacaaggacaaggtgagatacaaagaactgnggcttgacacattcttgtcttcaattccttcccgctaacttcgtaacg

SEQ ID NO: 324522 - DNA, 521 bp, Homo sapiens
  misc_feature: GZ8MTXP01B5EB5.8.71.G05.1.454.CMB.2.raw
  modified_base (255)..(255): a, c, t, g, unknown or other
  misc_feature (255)..(255): n is a, c, g, or t
  modified_base (502)..(502): a, c, t, g, unknown or other
  misc_feature (502)..(502): n is a, c, g, or t
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctctctctgtctgcttctgtgggagacagcgtcaccatcacttgccggcgagtcagtccattaacaactattaaatggtatcaanaaaacaggaaagccctaaatacctggtctatactgcatcactttgcaaagtggggtcccatcaaggttcagtggcagtggatttgggacagttttcactctcacaatcagcagtctcgaacctgaagattttgactaaacttactacttagtacaaacagacttaacaaataataccgagacgttcgtcgaaagggaccaaaggtggaagatacaaagaactgttggcttgcaccattcttgtcttnaatctccgccaattctaag

SEQ ID NO: 324523 - DNA, 550 bp, Homo sapiens
  misc_feature: GZ8MTXP01DC74J.8.71.G05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (480)..(480): a, c, t, g, unknown or other
  misc_feature (480)..(480): n is a, c, g, or t
  modified_base (506)..(506): a, c, t, g, unknown or other
  misc_feature (506)..(506): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggnagtcagtccattaacaactattaattgtatacaacaaaacaggaaagaccctaaatacctggtactatactgcatccactttgacaaagtgggtcccatcaaggttcagtgctagtggatttgggactagttttacactctacaacaatcagcagtctacgaacctgaagtattttgactaaactttactactgtacaaacagtaacttaacaataactaaccggaggtacgttcggtacgaagggaccaagggtganagtacaaaagaactgttggcttgacnccttattcttagttctctaattcctcccgactaacttcgtaacg

SEQ ID NO: 324524 - DNA, 565 bp, Homo sapiens
  misc_feature: GZ8MTXP01D38C5.8.71.G05.1.454.CMB.2.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (513)..(513): a, c, t, g, unknown or other
  misc_feature (513)..(513): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcaccatcacttgccggnagtcagtccattaacactattaatgtatacaaacaaaacaggaacaccctaaatacctggtactatactgacatccactttgacaaagtcgggtacccatcgaagttcagtggctaggtggtatttgggactaggttttacactctacaactaatcgagctagtcctacgaacctaggtaaacgttatttagactaaactttactactcgtacaaacagtaacttaacaaattactaaccggaaggtacgttcggaacgaagggaccaaagggtgaagatacgaaagaactgnggcttgacacgttattccttagtctcaagttcctcccgactaacgttctaag

SEQ ID NO: 324525 - DNA, 548 bp, Homo sapiens
  misc_feature: GZ8MTXP01DAZAG.8.71.G05.1.454.CMB.2.raw
  modified_base (221)..(221): a, c, t, g, unknown or other
  misc_feature (221)..(221): n is a, c, g, or t
  modified_base (436)..(436): a, c, t, g, unknown or other
  misc_feature (436)..(436): n is a, c, g, or t
  modified_base (523)..(523): a, c, t, g, unknown or other
  misc_feature (523)..(523): n is a, c, g, or t
  modified_base (536)..(536): a, c, t, g, unknown or other
  misc_feature (536)..(536): n is a, c, g, or t
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggnagtcagtccaattaacaatattaaattggtatacaaacaaaaccagggaaacgaccctaaaatacctggtactatactgacatccactttgacaaaagtgggggtacccagtacaaggttcagtggcagtggatttgggactagttttcactctcacaaatcagcagtctacgaacctgaaagtattttgactaaactttactactgtacaacanacttaacaatataaccgagtacgtacgtacaaagggaccaaaggtggaagatacgaaaacgaactgttggcttgactaccattcttntctcaatctcccnctaacttctaag

SEQ ID NO: 324526 - DNA, 576 bp, Homo sapiens
  misc_feature: GZ8MTXP01DTBO1.8.71.G05.1.454.CMB.2.raw
  modified_base (223)..(223): a, c, t, g, unknown or other
  misc_feature (223)..(223): n is a, c, g, or t
  modified_base (565)..(565): a, c, t, g, unknown or other
  misc_feature (565)..(565): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctggtgggagacagcgtcaccatcacttgccgggnagtcagtccattaacaactattaaatgtatacaaacaaaacagggaaacaccctaaatacctggtactaatactgacatcctactttagactaaaaggtcgggggtaccccaatacgaaaggttcaagtggcaggtggtatttgggactagttttcacttctacaacaatcagcagtctacgaacctagaaagtattttagactaaacttactactagtacaaacagtaacttaacaataactaaccggaagtacgttacggtacgaaacgggacaaagggtggaagatacaaaagaactggttaggcttcgacaaccagttccttatcttctaactctccncctcttctaag

SEQ ID NO: 324527 - DNA, 545 bp, Homo sapiens
  misc_feature: GZ8MTXP01CLV07.8.71.G05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (522)..(522): a, c, t, g, unknown or other
  misc_feature (522)..(522): n is a, c, g, or t
  modified_base (534)..(534): a, c, t, g, unknown or other
  misc_feature (534)..(534): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggnagtcagtccaattaaacaactatttaaatggtatacaanaaaacaggaaanccctaaatacctggtctatactgcatccactttgacaaagtggggtcccaatcaagttcagtggcagtggatttgggactagttttcactctcacaaatcagcagtctacgaacctgaaagtattttagactaaactttactaactgtacaaacaagacttaacaaataacttaaaccgaggacgttacggtcaaaggggtaccaaaggtggaagatacaaacgaaatgaggcttgacacattcttgtnttcaatcttccnccaattctaag

SEQ ID NO: 324528 - DNA, 515 bp, Homo sapiens
  misc_feature: GZ8MTXP01CSEQA.8.71.G05.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (252)..(252): a, c, t, g, unknown or other
  misc_feature (252)..(252): n is a, c, g, or t
  modified_base (472)..(472): a, c, t, g, unknown or other
  misc_feature (472)..(472): n is a, c, g, or t
  modified_base (509)..(509): a, c, t, g, unknown or other
  misc_feature (509)..(509): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccggnagtcagtccattaacatattaatgtatcaanaaaacaggaaagccctaaatacctggtctatactgcatccactttgacaaagtggggtcccatcaagttcagtgcagtggatttgggactagttttcactctcacaatcagcagtctacgaacctgaagtatttgactaactttactactgacaacagaacttacaataataccgagtacgttcggtacaagggaccaaggtgagatacgaaagaactgnggcttgacacattcttgtcttcaatcttcccgctaanctaacg

SEQ ID NO: 324529 - DNA, 533 bp, Homo sapiens
  misc_feature: GZ8MTXP01AGISF.8.71.G05.1.454.CMB.2.raw
  modified_base (197)..(197): a, c, t, g, unknown or other
  misc_feature (197)..(197): n is a, c, g, or t
  modified_base (507)..(507): a, c, t, g, unknown or other
  misc_feature (507)..(507): n is a, c, g, or t
  modified_base (512)..(512): a, c, t, g, unknown or other
  misc_feature (512)..(512): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcgagtcagtccaattaacaactatttaaattggtatcaaacaaaaccagggaaagacccctaaatacctggtctatactgcatccactttgacaaagtggggtcccatcaaggttcagtggcagtggatttgggactagttttcactctcacaatcagcagtctacgaaccctgaagtattttgactaaactttactactgtacaacagaacttacaatataccgaggacgttcggacaagggaccaagggtgagatacaaacgaactgttggcttgacacattcngtctnaatcttccgctaacttctaag

SEQ ID NO: 324530 - DNA, 531 bp, Homo sapiens
  misc_feature: GZ8MTXP01EYI0W.8.71.G05.1.454.CMB.2.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (505)..(505): a, c, t, g, unknown or other
  misc_feature (505)..(505): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcaccatcacttgccgggnagtcagtccattaacaactatttaaattggtatacaacaaaacaggaaagcccctaaaatacctggtctatactgcatccactttgcaaagtgggtcccatcagttcagtgcagtggattgggacagtttcactctcacaatcagcagtctcgaacctgaagtattttgctaaacttactactgtacaacagaacttacaatactaaccgagacgttacggtacgaagggaccaaagggtggaagactacgaaaacgaactgttaggcttagccaaccagttcngtcttcaatctcccgctaattctaag

SEQ ID NO: 324531 - DNA, 588 bp, Homo sapiens
  misc_feature: GZ8MTXP01CEQ4L.8.71.G05.1.454.CMB.2.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (526)..(526): a, c, t, g, unknown or other
  misc_feature (526)..(526): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctctctctgtctgcttctgtggganacagcgtcaccatcacttggccgggngagtcagtccaattaacaacttattaaatgtaatacaaacaaaaccgaggaaacaccctaaatacctggtactatactgacatccactttgacgtaaaggtcggggtacccaatacgaaggttcagtggcagtggtattgggactagttttacactctacaacaatcagcagtctacgaacctagaaagtatttgactaaacttactactgtacaaacagactttaaacaataacgtaacggaggtacgttacggacgaaagggaaccaaggggtgtaagaactaacgaaaacgaattagggngacttacgacctaacttcgttcttcgttcttctaacttccctacccgactaacgttcgtaag

SEQ ID NO: 324532 - DNA, 544 bp, Homo sapiens
  misc_feature: GZ8MTXP01BH6Z9.8.71.G05.1.454.CMB.2.raw
  modified_base (222)..(222): a, c, t, g, unknown or other
  misc_feature (222)..(222): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggnagtcagtccattaacaatattaaatggtatcaaacaaaacaggaaagccctaaatacctggtctatactgcatccactttgacaaagtggggtacccatcaaggttcagtggcaggtggatttgggactagtttcactctcacaatcagcagtctacgaactgaaagtattttgactaaacttactactgtacaaacagaacttaacaaataactaaccggaagtacgttacggtacgaagggaccaaagggtgaacggatacgaaagaactgttggcttgcaccattcttagtcttcaattcctcccgactaattcgtaag

SEQ ID NO: 324533 - DNA, 535 bp, Homo sapiens
  misc_feature: GZ8MTXP01DQG72.8.71.G05.1.454.CMB.2.raw
  modified_base (270)..(270): a, c, t, g, unknown or other
  misc_feature (270)..(270): n is a, c, g, or t
  modified_base (467)..(467): a, c, t, g, unknown or other
  misc_feature (467)..(467): n is a, c, g, or t
  modified_base (509)..(509): a, c, t, g, unknown or other
  misc_feature (509)..(509): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctgtgggagacagcgtcaccatcacttgccgggcagtcagtccaattaacaatattaaatgtatacaaacaaaacaggaaacnccctaaatacctggtctatactgcatccactttgacaaaggtgggtacccatcaaggttcagtggcagtggtatttggggactagtttcactctacacaatcagcagtctacgaacctgaagtatttagactaaacttactactgtacaactagtaactacaatactacggagtacgtggacaagggacaaggtganatacaaacgaactggttggcttgacacattcgttgtcttacncttccgtcccactaacgttccgtaag

SEQ ID NO: 324534 - DNA, 564 bp, Homo sapiens
  misc_feature: GZ8MTXP01CX3VA.8.71.G05.1.454.CMB.2.raw
  modified_base (222)..(222): a, c, t, g, unknown or other
  misc_feature (222)..(222): n is a, c, g, or t
  modified_base (510)..(510): a, c, t, g, unknown or other
  misc_feature (510)..(510): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggnagtcagtccattaacaactattaaatgtatacaaacaaaacaggaaacaccctaaatacctggtactatactgcatccactttgacaaagtgggtacccatcaaggttcagtgcagtggattgggactagtttacactctacacaatcagcagtctacgaacctagaagtattttagactaaacttactactgtacaaacataacttaacaattactaaccggaaggacgttacggtacgaaagggtaccaaagggtggaagaatacaaacgtaaactgttagggtcnggtacaccttagttcttacgtcttacaacttccttccccgactaacttctaacg

SEQ ID NO: 324535 - DNA, 522 bp, Homo sapiens
  misc_feature: GZ8MTXP01DMCXG.8.71.G05.1.454.CMB.2.raw
  modified_base (196)..(196): a, c, t, g, unknown or other
  misc_feature (196)..(196): n is a, c, g, or t
  modified_base (356)..(356): a, c, t, g, unknown or other
  misc_feature (356)..(356): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctccttggctccgaggtgccagttgtgacatccagttgacccagtctccctcctctctgtctgcttctgtggganacagcgtcaccatcacttgccgggcagtcagtccattaacactattaatggtatcaacaaaacaggaaagccctaaatactggtctatactgcatccactttgacaaagtggggtcccatcaaggttcagtgcagtggatttgggactagttttcaactntcacaatcagcagtctacgactgaagtatttgactaacttactactgtacaacaagtacttaacaactagtacccgaggtaacgtttcggacaagggaccaaggtagagtatacaaagaactgtggctgcacattcgttnttactntatcctcncttatcgngaag

SEQ ID NO: 324536 - DNA, 621 bp, Homo sapiens
  misc_feature: GZ8MTXP01C5LT7.8.71.G05.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccggnagtcagtccattaacaatattaatgtatcaacaaaacaggaagaccctaaatacctggtctatactgcatccactttgactaaagtgggtcccatcaaggttcagtgcagtggtattgggactagttttcacttctcaacaatcagctagtctacgaacctgaagtattttgactaaactttactactagtacaaacagtaacttaacaaattaacgtaacccggtaaggtaccgtttacgggtaccgaaaggggacccgtaaaggggttcgggaagtaacgtaacgtaaaacgggtaaaccttgggttacgggtacttcggaccctaccccttaaagttccttagggttccctttaccgtaactttcccgtttcccccggacctaacttccgttaacgg

SEQ ID NO: 324537 - DNA, 562 bp, Homo sapiens
  misc_feature: GZ8MTXP01EZEVL.8.71.G05.1.454.CMB.2.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcaccatcacttgccggnagtcagtccattaacactattaatgtatcaacaaaacaggaaagccctaaatacctggtctatactgcatccactttgacaaagtggggtcccatcaaggttcagtgcagtggatttgggactagtttcactctcacaatcagcagtctacgaactgaacgtattttgactaaacttactactgtacaacagtacttaacaatactaacgagtacgttcggtacgaaacgggtaccgaagggtaggaagtaagtaacgaaaaaggaacgttggttacgggacttggaccaacttagttcttcgttccttcaactttcccgtcccgacctaacttccgtaagg

SEQ ID NO: 324538 - DNA, 548 bp, Homo sapiens
  misc_feature: GZ8MTXP01ELLIN.8.71.G05.1.454.CMB.2.raw
  modified_base (221)..(221): a, c, t, g, unknown or other
  misc_feature (221)..(221): n is a, c, g, or t
  modified_base (535)..(535): a, c, t, g, unknown or other
  misc_feature (535)..(535): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccggnagtcagtccattaacaactattaaatgtatacaaacaaaacaggaaacaccctaaatacctggtactatactgcatccactttgacaaagtggtcccatcaagttcagtgcagtggatttgggactagtttcactctacaacaatcagcagtctacgaactgaagtatttgactaaacttactactgtacaaacagtaacttaacaaataacgtaccgaggtacgtttacggacgaaagggaccaaagggtgtaagatacaaagaactgttggcttgacctaccagttcttactcttacaacttcccgttcccnctaacttcgtaag

SEQ ID NO: 324539 - DNA, 562 bp, Homo sapiens
  misc_feature: GZ8MTXP01AH2EC.8.71.G05.1.454.CMB.2.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (266)..(266): a, c, t, g, unknown or other
  misc_feature (266)..(266): n is a, c, g, or t
  modified_base (361)..(361): a, c, t, g, unknown or other
  misc_feature (361)..(361): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcaccatcacttgccggnagtcagtccattaacactattaaatgtatacaacaaaaccaggaanccctaaatacctggtctatactgcatccactttgacaaagtgggtcccatcaaggttcagtgcagtggattgggctagtttcactctcacatcancagtctacgaactgaatatttgactaacttactactgtacaaactagtacttaacaataactaaccggaggtacgttaccggtacgaaacggggaccctaaaggggacggtagaacttaccgaaacgtaactaggttcggacttggaccaccaattccgttgttccttctaacttcctttaccccgctaacttcccgtaag

SEQ ID NO: 324540 - DNA, 531 bp, Homo sapiens
  misc_feature: GZ8MTXP01AFWNH.8.71.G05.1.454.CMB.2.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (359)..(359): a, c, t, g, unknown or other
  misc_feature (359)..(359): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcaccatcacttgccggngagtcagtccattaacaactattaatgtatcaacaaaaccaggaagccctaaatacctggtctatactgcatccactttgacaaagtcggggtcccatcaaggttcagtggcagtggatttgggactagtttcactctnacaatcagcagtctcgaacctgaagtattttgactaacttactactcgtacaacagtacttacaatactaccgagtacgttcgtacgaagggaccaaggtgagatacaaagtaactggttaggcttgcgacttattcttgttcttcaacttccttcccgctcgttctaacgg

SEQ ID NO: 324541 - DNA, 527 bp, Homo sapiens
  misc_feature: GZ8MTXP01EWS0L.8.71.G05.1.454.CMB.2.raw
  modified_base (269)..(269): a, c, t, g, unknown or other
  misc_feature (269)..(269): n is a, c, g, or t
  modified_base (486)..(486): a, c, t, g, unknown or other
  misc_feature (486)..(486): n is a, c, g, or t
  modified_base (504)..(504): a, c, t, g, unknown or other
  misc_feature (504)..(504): n is a, c, g, or t
  modified_base (516)..(516): a, c, t, g, unknown or other
  misc_feature (516)..(516): n is a, c, g, or t
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccggcgagtcagtccattaacaactattaaatgtatacaaacaaaacaggaaanacccctaaatacctgtctatactgcatccactttgacaaaggtgggtcccatcaaggttcagtggcagtggatttgggactagttttcactctcaacaatcagcagtctacgaactgaaagtatttagactaaactttactaactgtacaaacagtaacttaacaagtataaccgaggacgttgtacaaaggacaaggtgagatacaaacgaactgnggcttgcacattcttgtntctaactctccncctaacttctg

SEQ ID NO: 324542 - DNA, 628 bp, Homo sapiens
  misc_feature: GZ8MTXP01ASG83.8.71.G05.1.454.CMB.2.raw
  modified_base (224)..(224): a, c, t, g, unknown or other
  misc_feature (224)..(224): n is a, c, g, or t
  modified_base (432)..(432): a, c, t, g, unknown or other
  misc_feature (432)..(432): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctggtgggagacagcgtcaccatcacttgccgggnagtcagtccattaacaacttattaatgtatacaaacaaacaggaacaccctaaatacctggtactatactgactatcctactttgactaaaggtcgggtaccccattacgtaaaggttcaaggtcggacgtacggttgggtagtttggggaacttaggttttaccacttctacaactaatcagcagttcctacgtaacctagaagttntttacgactaacttactactagacaacagtacttaacaagttactaccggtaggtaccgttcggtaacgaacggggaaccaaggggtggaacgactaacgaaacgtaacgtggttcgggacttcggacctaaccttatttccgttacggttcccttactaactttccccttacccggccttaacgttccgtaacgg

SEQ ID NO: 324543 - DNA, 508 bp, Homo sapiens
  misc_feature: GZ8MTXP01A4QTF.8.71.G05.1.454.CMB.2.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (264)..(264): a, c, t, g, unknown or other
  misc_feature (264)..(264): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
tcagctcgcgtgtccacgaccggtgctcgatttagtgtcgtcgcaagagagaggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcaccatcacttgccggnagtcagtccattaacactattaatgtatcaacaaaaccagggaaancccctaaatacctggtctatactgcatccactttgcaaagtggtccatcaaggttcagtgcagtggatttgggactagtttcacttctcacaatcagcagtctcgaacctgaagtattttgcaacttactaactgtacaaacagacttacaaatagtacccgaggacgttggtcaaaggaccaaaggtgaagatacaaacgaatggttggcttgcnccattcngtctnaattctcccnctnctg

SEQ ID NO: 324544 - DNA, 559 bp, Homo sapiens
  misc_feature: GZ8MTXP01DMT02.8.71.G05.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (297)..(297): a, c, t, g, unknown or other
  misc_feature (297)..(297): n is a, c, g, or t
  modified_base (422)..(422): a, c, t, g, unknown or other
  misc_feature (422)..(422): n is a, c, g, or t
  modified_base (507)..(507): a, c, t, g, unknown or other
  misc_feature (507)..(507): n is a, c, g, or t
  modified_base (534)..(534): a, c, t, g, unknown or other
  misc_feature (534)..(534): n is a, c, g, or t
  modified_base (546)..(546): a, c, t, g, unknown or other
  misc_feature (546)..(546): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctgtggganacagcgtcaccatcacttgccgggngagtcagtccattaacaactattaaatgtatacaaacaaaacaggaaacaccctaaatacctaggtactatacngacatccactttgacaaaggtcgggtcccatcgaagttcagtgcagtggtattggactagtttacactcacaacaatcagcagtctacgaacctaggaacgtatttacgactaaacttactactntacaaacagtacttaacaagtaactaccggaagtacgttacggtacgaagggaccgaaagggtgtaagatacgaaacgtaatggngacttgactacaacgttcttgtccttnaacttcctcccnctaacttcgtaag

SEQ ID NO: 324545 - DNA, 561 bp, Homo sapiens
  misc_feature: GZ8MTXP01AP8SP.8.71.G05.1.454.CMB.2.raw
  modified_base (198)..(198): a, c, t, g, unknown or other
  misc_feature (198)..(198): n is a, c, g, or t
  modified_base (510)..(510): a, c, t, g, unknown or other
  misc_feature (510)..(510): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcgagtcagtccattaacaactatttaaattgtatacaaacaaaacaggaaacgaccctaaatacctgtctatactgcatccatttgacaaagtgggtcccatcaaggttcagtggcaggtggagtttgggactagtttcactctacacatcagcagtctacgaactgaatattttagactaacttactatgacaactacgtacttaacaatactaccggagtacgttcgtacgaagggaccaagggtgaagataacgaaacgtaacgtggttcggcttcgacctaacncgttcttcgttccttctaacgttcccttcccgacctaacgttccgtaacgg

SEQ ID NO: 324546 - DNA, 650 bp, Homo sapiens
  misc_feature: GZ8MTXP01CCECX.8.71.G05.1.454.CMB.2.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (397)..(397): a, c, t, g, unknown or other
  misc_feature (397)..(397): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctgtggganacagcgtcaccatcacttgccggnagtcagtccattaacaatattaatgtatacaaacaaaacaggaacaccctaaatacctgtactatactgacataccactttgacaaaggtcgggtacccatcaagttcagtgcagtggatttgggactagtttacactctacaactaatcagcagtctacgtaacctagaacgtnttttacgactaaactttacgtactcgtaacaaactagtaacttaacaagttaactaaccggaaggttaccggttacggtaaccgaaacggggtaacccgaaaagggttcggaaagtaagtaaccgaaaacggtaaaccttggggttacgggacccttaggaacccctaaccgttaacgtttccttacggtttaacctttacccggtaactttccccgtttcccccggaccctaaacgtttcccgtaaaccggg

SEQ ID NO: 324547 - DNA, 579 bp, Homo sapiens
  misc_feature: GZ8MTXP01AEGPD.8.71.G05.1.454.CMB.2.raw
  modified_base (197)..(197): a, c, t, g, unknown or other
  misc_feature (197)..(197): n is a, c, g, or t
  modified_base (268)..(268): a, c, t, g, unknown or other
  misc_feature (268)..(268): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcgagtcagtccattaacaactattaattgtatcaacaaaacaggaanaccctaaatacctggtctatactgcatccactttgactaaaggtcggggtcccaatcgaagttcagtggacagtggtatttgggactagttttcactctcacaatcagcagtctacgaacctgtaagtattttgactaaacttactaactcgtacaaactagtacttaacaaacttacgtaaccggaaggtaccggtttacggtacgaaacggggtaccgaagggtaggagtaatacgtaaacgaacgtggagggtcacgctacccaagttccttgttcctctaacttccctaccccggactcttcgaacg

SEQ ID NO: 324548 - DNA, 535 bp, Homo sapiens
  misc_feature: GZ8MTXP01CGS8N.8.71.G05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggnagtcagtccattaacaactattaaatggtatcaacaaaaccaggaaagcccctaaatacctggtctatactgcatccactttgcaaagtggggtcccatcaaggttcagtggcagtggatttgggactagttttcactctcacaatcagcagtctacgaacctgaagtattttgactaaactttactactgtacaaacagacttaacaattaactaaccgaggaccgttacgtacgaaagggaccaaagggtggaagatacaaagaactgttggcttgacacattcttgtctcaatctccgctaattcgtaag

SEQ ID NO: 324549 - DNA, 584 bp, Homo sapiens
  misc_feature: GZ8MTXP01C4LUD.8.71.G05.1.454.CMB.2.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (293)..(293): a, c, t, g, unknown or other
  misc_feature (293)..(293): n is a, c, g, or t
  modified_base (399)..(399): a, c, t, g, unknown or other
  misc_feature (399)..(399): n is a, c, g, or t
  modified_base (530)..(530): a, c, t, g, unknown or other
  misc_feature (530)..(530): n is a, c, g, or t
  modified_base (577)..(577): a, c, t, g, unknown or other
  misc_feature (577)..(577): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttggccgggnagtcagtcattaacaatattaatgtatacaaacaaaaccagggaaacaccctaaatactagtctatacngcactcactttgacaaagtcgggtacccatacgaaggttcagtgacgtagtggtattgggatagtttacactctcaactaatcagcagtctacgaactgaaacgtntttacgactaaactttactactagacaaacgataacttacaaactactaacccgggaaggtaccggttacggtaacgtaaacgggacctaaaggggtgtaaagaataacgaaaacgtaacgtgacggtccngtacccaacgttattcttgttcctactcttcccttcccgacttaacncgtaacg

SEQ ID NO: 324550 - DNA, 549 bp, Homo sapiens
  misc_feature: GZ8MTXP01ALEMU.8.71.G05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (525)..(525): a, c, t, g, unknown or other
  misc_feature (525)..(525): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggnagtcagtccattaacaactattaatgtatacaaacaaaacaggaacaccctaaatacctggtctatactgcactcctactttgactaaagtcggggtcccatcgaaggttcagtggcacgtggatttgggactagtttcactctcacaatcagcagtcacgtaacctgaacgttatttgactaacttactactagtactaaacagtacttaacaatactaaccggtaggtacgtttacggacgaacggaccgtaagggtgagaactacgaaacgaacgtggttggacttgactcacttcgttntctcaactcctcccatcttgaacc

SEQ ID NO: 324551 - DNA, 537 bp, Homo sapiens
  misc_feature: GZ8MTXP01EA6AG.8.71.G05.1.454.CMB.2.raw
  modified_base (221)..(221): a, c, t, g, unknown or other
  misc_feature (221)..(221): n is a, c, g, or t
  modified_base (269)..(269): a, c, t, g, unknown or other
  misc_feature (269)..(269): n is a, c, g, or t
  modified_base (509)..(509): a, c, t, g, unknown or other
  misc_feature (509)..(509): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccggnagtcagtccattaacaactattaaatgtatacaaacaaaacaggaaancccctaaatacctgtactatactgcatccactttgacaaagtgggtacccatcaaggttcagtggcagtggtattgggactagttttcactctcaacaatcagcagtctacgaacctgaagtatttgactaaacttactactgtacaacagtaacttaacaatactacggaggtacgttacggtacgaagggaaccaagggtgaagatacaaagaactggttggcttgcaccattcgttntctcaatccttcccgctaacttctaacg

SEQ ID NO: 324552 - DNA, 638 bp, Homo sapiens
  misc_feature: GZ8MTXP01BOGF9.8.71.G05.1.454.CMB.2.raw
  modified_base (225)..(225): a, c, t, g, unknown or other
  misc_feature (225)..(225): n is a, c, g, or t
  modified_base (272)..(272): a, c, t, g, unknown or other
  misc_feature (272)..(272): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtctcccctcctctctgtctgcttctggtgggagacagcgtcaccatcacttgccgggnagtcagtccattaacaatattaatgtatacaaacaaaacaggaaacnccctaaatacctgtactatactgacactcctactttagactaaacggtcggggtacccctatacgtaaggttcaaggtggactaggtaggtagtttggggacttagttttacacttctacgaactaatcagtcagttcctacgtaaacctgtaaagttatttacgacttaaacttactactcgtacaaactacgtaacttaacaagttaactaaccgggaaggtaccggtttacggaccgaaaggggtaccaaaggggtgaaaggaacttacgaaaacgtaacgttggttcggacttacggctaacccttatttccgttcgttaaccttctaacttccctttccccgaccttaactttcgtaacgg

SEQ ID NO: 324553 - DNA, 586 bp, Homo sapiens
  misc_feature: GZ8MTXP01CP0MR.8.71.G05.1.454.CMB.2.raw
  modified_base (375)..(375): a, c, t, g, unknown or other
  misc_feature (375)..(375): n is a, c, g, or t
  modified_base (529)..(529): a, c, t, g, unknown or other
  misc_feature (529)..(529): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtctccctcctctctgtctgcttctggtgggagacagcgtcaccatcacttgccgggcagtcagtccattaaacaacttaatttaaattggtaatacaaacaaaaacgaggaaacaccctaaatacctgtactatactgcactccactttgactaaaggtcgggtacccatcaaggttcagtgcagtggattggatagtttcactctanacaatcagcagtctacgaactagaacttatttcgaactaactttactaatcgtaacaaactagtaaacttaacaagtaactaaccggagtaacgttacggagaaacgggacgaaaggtggaataatacgaaacgaactgttagggcttgaaccnccgttagttcttcgtttccttacgtaactttccctacccgacctaagttccgtaagg

SEQ ID NO: 324554 - DNA, 582 bp, Homo sapiens
  misc_feature: GZ8MTXP01CQRRA.8.71.G05.1.454.CMB.2.raw
  modified_base (221)..(221): a, c, t, g, unknown or other
  misc_feature (221)..(221): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccggngagtcagtccaattaacaactatttaattggtatacaaacaaaacaggaaacgacccctaaatacctggtctatactgcatcctactttgacaaaggtcgggtacccatcgaaggttcaggtggcaggtggtatttggggactagttttacacttctacaacaatcagcagtctacgtaacctagaaagttattttagactaaactttactacttgtacaaactagtaacttaacgaaattacgtaccggaggtacggttacggtacgaacggacgaagggtgaagactacgaaacgaactggttcgcttgaccacgttattcttcgttctctaacttccttcccgactaacttcgtaacg

SEQ ID NO: 324555 - DNA, 545 bp, Homo sapiens
  misc_feature: GZ8MTXP01CB82J.8.71.G05.1.454.CMB.2.raw
  modified_base (223)..(223): a, c, t, g, unknown or other
  misc_feature (223)..(223): n is a, c, g, or t
  modified_base (510)..(510): a, c, t, g, unknown or other
  misc_feature (510)..(510): n is a, c, g, or t
  modified_base (517)..(517): a, c, t, g, unknown or other
  misc_feature (517)..(517): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctggtgggagacagcgtcaccatcacttgccgggnagtcagtccattaacaatattaaatgtatcaacaaaacaggaagccctaaatacctgtactatactgcatccactttgacaaagtcgggtcccatcaaggttcagtggctagtggatttgggactagttttacacgtctcaactatcagcagtctacgtaacctgaacgtattttgactaactttactacctgtacaacacgtacttaacaatactaaccgagtacgttcggactaacgggacaagggtgaagatacgaaacgaactgttggcttggactacagttnttacgtntacaacttctcccgctaagttccgtaag

SEQ ID NO: 324556 - DNA, 538 bp, Homo sapiens
  misc_feature: GZ8MTXP01BYIBF.8.71.G05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (380)..(380): a, c, t, g, unknown or other
  misc_feature (380)..(380): n is a, c, g, or t
  modified_base (465)..(465): a, c, t, g, unknown or other
  misc_feature (465)..(465): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggnagtcagtccaattaacactattaaattggtatcaacaaaacagggaaagcccctaaatacctggtctatactgcatccactttgacaaagtgggggtcccatcaaggttcagtggcagtggatttgggactagttttacactctcacatcagcagtcncgaacctgaagtatttgactaacttactactgtacaacagtacttacaagtataccggagacgttcggtacaacgggactaaggnggtacgaataccaaaggaactgttggcttgcaccgattcttgtctcaactccttcccgctaacttcgtaacgg

SEQ ID NO: 324557 - DNA, 623 bp, Homo sapiens
  misc_feature: GZ8MTXP01EER6M.8.71.G05.1.454.CMB.2.raw
  modified_base (224)..(224): a, c, t, g, unknown or other
  misc_feature (224)..(224): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtctccctcctctctgtctgcttctggtgggagacagcgtcaccatcacttgccgggnagtcagtccattaacaactattaatggtatacaaacaaaacaggaacgaccctaaatacctggtctatactgcatcctactttgacaaaggtcgggtcccatcgaaggttcagtggcagtggtagttgggactagttttcactctcacatcagcagtctacgaacctgtaatatttgactaaacttactactgtacaactagtaacttaacaaattaacgtaaccggtaaggtaaccggtttacggtaacgtaaacggggtacctaaaaggggtgggaagtaacgttaaacgaaaaccgtaaacgttgggttacgggtacttacgggacctaacccttaattccgttacggttcctttactaaccggtttcccttccccggacctaattcccgtaaggg

SEQ ID NO: 324558 - DNA, 606 bp, Homo sapiens
  misc_feature: GZ8MTXP01BJZTZ.8.71.G05.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (546)..(546): a, c, t, g, unknown or other
  misc_feature (546)..(546): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgaccccagtctccctcctctctgtctgcttctggtggganacagcgtcaccatcacttgccgggngagtcagtccaattaacaactattaaatggtatacaaacaaaacagggaaacaccctaaatacctggtactatactgcatcctacttttgactaaaaggtcgggggtaccccctaagtacgtaaagggttccaaggttcgggactaggttggtagtttgggggacttagttttacacttctcacaatcagtcagtcctacgaacctgaagtatttgactaaacttactactgtacaaacagtaacttaacgaaattataaccggaggtaacggttcgtacgaacgggaccgtaaagggtggaaggataacaaacggaactgnggcttgaccaacttagttcgttcgttcttctaacttcctcccgttacctcttcgtaacgg

SEQ ID NO: 324559 - DNA, 661 bp, Homo sapiens
  misc_feature: GZ8MTXP01EUT49.8.71.G05.1.454.CMB.2.raw
  modified_base (224)..(224): a, c, t, g, unknown or other
  misc_feature (224)..(224): n is a, c, g, or t
  modified_base (465)..(465): a, c, t, g, unknown or other
  misc_feature (465)..(465): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtctccctctctctgtctgcttcgtgtgggagacagcgtcaccatcacttggccgggnagtcagtccaattaacaactattaaatgtatacaaacaaaacaggaacaccctaaatactggtactatactgacatacctactttgactaaaggtcggggtaccccaatacgtaaggttcaaggtcggacaggttggtagtttcgggaactaggttttaccacttctacaacaatcagctagtctacgtaactgtaagtatttgactaaacttactatacgtacaaactacgtaacttaanaaacttacgtaacccggaaggtaccggttacggtaacgaaacggggtaaccgtaaagggggtaggaaaggtaacttaaacgaaaacggaaacgttggttaaccggggtcttacggtaccaaaccttaacgttccgttacggttccttacctaaacctttccccggttaccccgaccccgttaattcgttaaccggg

SEQ ID NO: 324560 - DNA, 549 bp, Homo sapiens
  misc_feature: GZ8MTXP01DU3RY.8.71.G05.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
  modified_base (521)..(521): a, c, t, g, unknown or other
  misc_feature (521)..(521): n is a, c, g, or t
  modified_base (537)..(537): a, c, t, g, unknown or other
  misc_feature (537)..(537): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggnagtcagtccattaacaatattaaatgtatacaaacaaaaccaggaaanaccctaaatacctgtctatactgcatccactttgacaaagtgggtcccatcaagttcagtgcagtggattggactagtttacactctacaacaatcagcagtctacgaactagaaagtattttagactaaacttactactagtacaacaataacttaacaaataactaaccggaggtaacgttacggtacgaaagggaccgtaaagggtggaagaatacgaaaacgaagtgaggcttgacaccattcttntcttcaattccttccnctaacttctaag

SEQ ID NO: 324561 - DNA, 635 bp, Homo sapiens
  misc_feature: GZ8MTXP01C7KLU.8.71.G05.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtcctccctcctctctgtctgcttcgtgtggganacagcgtcaccatcacgttggccggnagtcagtccaattaacaacttattaatgtaatacaaacaaaacgaggaaacaccctaaatacctgtactatactgactactcctactttagacgtaaaggtcgggtacccagtacgtaaggttcaggtgactaggtggtagtttgggacttagttttacacttctacaactaatacagactacgtacctacgaaccttagaaacgttatttacgaactaaactttactactacgtaacaaactacgtaacttaaccaaagtaaccgtaaccggtaaggtaccgttacggaacgaaacgggaaccgtaaagggtacggaaataacgtaacgaaaacggtaacttaggcggtacttcgacaaccttattcttacgttccttacaacttccctacccgctaacgttcgaacg

SEQ ID NO: 324562 - DNA, 558 bp, Homo sapiens
  misc_feature: GZ8MTXP01C2KQU.8.71.G05.1.454.CMB.2.raw
  modified_base (221)..(221): a, c, t, g, unknown or other
  misc_feature (221)..(221): n is a, c, g, or t
  modified_base (476)..(476): a, c, t, g, unknown or other
  misc_feature (476)..(476): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccggnagtcagtccattaacaactattaaatgtatcaacaaaacaggaaacgaccctaaatacctggtactatactgcatccactttgacaaagtggggtcccatcaaggttcagtggcagtggatttgggactagttttcactctcacaatcagcagtctacgaacctgaagtatttgactaaatttactaactgtacaaacagtacttaacaatactaccggagtacgttacgtacgaaagggaccaaagggtggaanatacaaaacgtaactggttaggcttggcctaaccagttcttagttccttcaacttcctttccccgacctaacgttctaacgg

SEQ ID NO: 324563 - DNA, 651 bp, Homo sapiens
  misc_feature: GZ8MTXP01B48ZW.8.71.G05.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (273)..(273): a, c, t, g, unknown or other
  misc_feature (273)..(273): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgaccccagtctccctctctctgtctgcttctggtggganacagcgtcaccatcacttgccgggnagtcagtccaattaacaactattaatgtatacaaacaaaaccaggaaacnccctaaatacctggtctatactgcatcctactttgacaaaggtcggggtacccaagtacgtaaggttcaaggtggctacggtgggtagttttggggactagttttacaacttctacaactaaatcagcacgttactaccgtaaccgtaggtaagtattttacgacttaaacttacctaacttcgtactaacgtaagtaaccttaaacaaacttacgttaaccggtaacgggttaccgtttaccggtacgtaaacggggtaaccgtaaaggggttacgaaggtaacgtaacaaaccgtaaacgtggttacggtcttcgaccacttaagttcttacgttccttactaacttccgttaccccgacctaacgttcgtaaccg

SEQ ID NO: 324564 - DNA, 655 bp, Homo sapiens
  misc_feature: GZ8MTXP01CLEXA.8.71.G05.1.454.CMB.2.raw
  modified_base (198)..(198): a, c, t, g, unknown or other
  misc_feature (198)..(198): n is a, c, g, or t
  modified_base (386)..(386): a, c, t, g, unknown or other
  misc_feature (386)..(386): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctgtggganacagcgtcaccatcacgttggccgggcgagtcagtccaattaaacaactatttaaattggtatacaaacaaaaccagggaaacgacccctaaatacctggtactatactgcatccactttgacaaaggtggggtacccatcgaagttcagtggcagtggatttggggactagtttcactctcaacatnagcagtctacgaactgaagtatttgactaactttactactagtacaaactagtaacttaaacaacgttaacgttaaccggaggttaacccggtttacgggttaaccgaaacgggggtaacccgtaaaggggtaccggaaagtaacttaaaccgaaaacggtaaaccttgggttacgggtacttacggaaccctaaccttacttaccgttcggttaaccctttaccgtaactttccccgttaccccggacctaacttccgttaaaccggg

SEQ ID NO: 324565 - DNA, 598 bp, Homo sapiens
  misc_feature: GZ8MTXP01DI4JT.8.71.G05.1.454.CMB.2.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (411)..(411): a, c, t, g, unknown or other
  misc_feature (411)..(411): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcacatcacttgccggnagtcagtccattaacaatattaatgtatacaaacaaaacaggaacgtaccctaaatacctaggtctatactgctactcctactttgactaaaggtcggggtacccatcgaagttcagtggctaggtggtagtttgggactagttttaccaacttctacacaaatcagctagtctacgaactgtaagtatttnactaaacttactactgtacaaatagtaacttacaaattaacgtaaccggtaagtacggttacggtacgaaaggggtaaccaaagggtagaagaactaacgaaaacggtaactaggttcggacgttcgacaacttacgttcttacgttccttacgtaacttcccgttcccgacctaacttccgtaagg

SEQ ID NO: 324566 - DNA, 591 bp, Homo sapiens
  misc_feature: GZ8MTXP01AO10O.8.71.G05.1.454.CMB.2.raw
  modified_base (224)..(224): a, c, t, g, unknown or other
  misc_feature (224)..(224): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctgtgggagacagcgtcaccatcacttggccgggnagtcagtccattaacaatattaatgatatacaaacaaaacgaggaaacaccctaaatacctaggtactatactgactactcctactttgactaaaggtcggggtaccagtctaaggttcaggtggcctaggtggtagtttagggactaacgttttcaactctacacatcagctagtctacgaactagaagttatttagactaacttactatcgtaacaacagtaacttaactaaattacgtaacgacgggtaaccgttcggacgaaacgggtaccgtaagggtaggaacgtactaacgaaacgtaaacgttggtacgttcgtacgacaccgttattcgtaatcttcactcccttcccgtcttcgtcg

SEQ ID NO: 324567 - DNA, 708 bp, Homo sapiens
  misc_feature: GZ8MTXP01A1ULD.8.71.G05.1.454.CMB.2.raw
  modified_base (200)..(200): a, c, t, g, unknown or other
  misc_feature (200)..(200): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttcgacccagtcctccctcctctctgtctgcttctgtggganacagcgtcaccatcacttggccgggcgagtcagtaccaattaacctaacttaatttaaattggtaatacaaaccaaaaaccgaagggaaacgacccctaaatacctaggtactaatactgacactacctactttagactaaaggtcgggggtacccaatacgaaaggtttcaggtggacgtacggttggtagtttacggggtacttacgtttttaccaaccttccttacaaactaacttacaagacctagtacccttaaccgtaaacccttagtaaagttacgttttacaactaaaccttacttaacgtacgttaacaaacgtaacgtaaacttaacaaacgttaacgtaaccggaacgggttaaccggtttacggtaacgaaaccggggtaaccaaggggttaggaacgtaaacttaccgaaaacgtaacgtaggttacggcttagtaccaacttcgttcttacgtttcctctaaccttcccttacccgacctaacttccgtaaccg

SEQ ID NO: 324568 - DNA, 566 bp, Homo sapiens
  misc_feature: GZ8MTXP01DGJ2N.8.71.G05.1.454.CMB.2.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (266)..(266): a, c, t, g, unknown or other
  misc_feature (266)..(266): n is a, c, g, or t
  modified_base (432)..(432): a, c, t, g, unknown or other
  misc_feature (432)..(432): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcacatcacttgccggnagtcagtccaattaacaatattaatgtatacaacaaaacaggaaanccctaaatacctggtactatactgcatccactttgactaaaggtcgggggtacccctaatcgaaaggttcagtggctaggtggatttggggactagttttcacttctacaacaatcagcagtcctacgaacctagaagtatttgactaaacttactactgtacaanagtaacttacaagtactacgaagtacgttacggtacgaaagggaccaaagggtgaagactacaaacgaactgttacggacttgaccaacagttcttagttcttacaacttccttacccgctaacgttctaacgg

SEQ ID NO: 324569 - DNA, 564 bp, Homo sapiens
  misc_feature: GZ8MTXP01EHLWO.8.71.G05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttggccggnagtcagtccattaacaatattaatgtatacaaacaaaacaggaaacnccctaaatacctggtctatactgcatccatttgacaaaggttcgggtacccatcgaaggttcaggtggcagtggtagttgggatagtttacacttctacaacaatcagcagtctacgactgaagtatttgactaaacttactactgtacaacagtaacttacaatacgtacggagtacgttcgtacgaacgggacaagggtgaagaatacgaaagtaacgtgttggcttgaccctaacttagttccgttacttcctttacaactttcccgttccccgaccttaagttccgtaagg

SEQ ID NO: 324570 - DNA, 599 bp, Homo sapiens
  misc_feature: GZ8MTXP01AY7BJ.8.71.G05.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (391)..(391): a, c, t, g, unknown or other
  misc_feature (391)..(391): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggngagtcagtccattaacaactattaaatgtatacaaacaaaaccaggaaacgaccctaaatacctgtactatactgcatcctactttgactaaaggtcggggtacccagtacgaaggttcaaggtggactaggtggtagtttgggactagtttacactctacaactaancagctacgtctacgaacctagaagtatttcgactaaacttacttactcgtacaacgtataactttacaaagttactaaccggtaggtacggttacggtacgaaacggggaccgtaaagggtacggaagaacttaaccgaaaacgtaacgtgttggacttcgactacttattcttgtcctctaactccgttcccactaacttcgtaacg

SEQ ID NO: 324571 - DNA, 666 bp, Homo sapiens
  misc_feature: GZ8MTXP01CTNJJ.8.71.G05.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttcgacccagtcctccctcctctctgtctgcttcgtggtggganacagcgtcaccatcacttggccgggngagtcagtccaattaacaacttattaattgtaatacaaacaaaacgaggaaacaccctaaatacctgtactatactgactactcctactttagacgtaaaggtcgggtacccatacgtaaggttcaaggtggacgtaggttggtagtttggggaacttagttttaccacttctacaactaatcagctacgtcctacgtaactgtaaacgttatttacgaacttaaactttactactacgtacaaacgtagtaacttaacaagttaacgtaaccggtaaggtaccgttacggtaacgaaacggggtaccgtaaagggtaggaagtaacgttaaccgaaaacggtaacgtgggttacggtacgttcgtacctaccgttaacttcgttacgtttaaccttacctcttaccccgtttcccgacccttaagttcccgtaaggg

SEQ ID NO: 324572 - DNA, 703 bp, Homo sapiens
  misc_feature: GZ8MTXP01AGID2.8.71.G05.1.454.CMB.2.raw
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttcgacccagtcctccctcctctctgtctgtcttctggtgggagacgagcgtcacctatctacgtcggccggcgagtcagtacctaataactaacttatttaaatgtaactacaaacaaaaccgagggaacaccccgtaaatacccgtaggtactatactgcctactcctacttgaacgtaaacggtcggggaccctagtacgaggttacaggtggtactaggtggtagtttgggaacttacgtttaacaccttctacaacctaatcaacgtacacgttaccgtaccgtaacgtagtaaacgttactttacgaaacctaacgttacctaactcgtaaactaactaactaaacctaactaacgttacgtaaccggtacggttaaccggtttaccggtaacggtaaacgggaaccgtaagggtaggaaagtacttaaaccggaaacggtaaactccggttaggtaccacggtacccgtaacttacgttccgttcgttaaccctacttaaccgttcccggttaccccccgattaaccttcgtaaccggg

SEQ ID NO: 324573 - DNA, 668 bp, Homo sapiens
  misc_feature: GZ8MTXP01B4YU9.8.71.G05.1.454.CMB.2.raw
  modified_base (202)..(202): a, c, t, g, unknown or other
  misc_feature (202)..(202): n is a, c, g, or t
  modified_base (471)..(471): a, c, t, g, unknown or other
  misc_feature (471)..(471): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttcgacccagtcctccctcctctctgtctgcttcgtggtggganacagccgtacaccatctacgttcggccgggacgacgtcacgtacctaattaaactaaacttatttaaagtgtaactaacaaaacaaaacgaggaaaccaccctaaataccgtgtactatactgactactcctactttacgaacgtaaagggtcgggtaccctagtacgtaaaggttcaggtggacgtaggtggtagtttagggactttacgtttacactctactaaatacgtcacgtacgtacgttacctacgtaactaggtaaacttntttacgacttaaacttctacgtactaacaaacgtacgtaacttaacgaacttacgtaaccgggtagtacccggttaggaaccgaaaggggtacctaaggggtcgaaataccgtaacgaaacgtaagttcgacgggtcttcggaacctacgttattcgttcttaacctctaacgttcccctaccgctcgttgtaacgg

SEQ ID NO: 324574 - DNA, 607 bp, Homo sapiens
  misc_feature: GZ8MTXP01B0FSP.8.71.G05.1.454.CMB.2.raw
  modified_base (200)..(200): a, c, t, g, unknown or other
  misc_feature (200)..(200): n is a, c, g, or t
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccacgttgacccagtctccctccgtctctgtctgcttctggtggganacagcgtcaccatcacttgccggcgagtcagtccattaacaactatttaaatggtatacaaacaaaaaccagggaaacacccctaaatacctggtactatactgcatcctactttgacaaaggtgggtacccatcgaagttcagtggctagtggtagttgggactagtttcactctcaacatcagcagtcncaactgaagtntttgactaacttactactcgtacaacagtacttaacaaacgtactaaccggagtacgttacggtacgaacgggaccaaagggtgaaggtaactacgaaaacgaaccgttggttcggtacacggaccgaaacccttacgttcgttccgttaacctttaccgtaacccgtttccccgttaccccgttaccttaacgttccgtaacgg

SEQ ID NO: 324575 - DNA, 506 bp, Homo sapiens
  misc_feature: GZ8MTXP02HQNEF.8.71.G05.1.454.CMB.2.raw
  modified_base (487)..(487): a, c, t, g, unknown or other
  misc_feature (487)..(487): n is a, c, g, or t
tcagctcgcgtgtccacgaccggtgctcgatttagtgtcgtcgcaagagagaggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactattaaatggtatcaacaaaaccagggaaagacccctaaatacctaggtctatactgcatccactttgcaaaagtggggtcccatcaaggttcagtggcagtggatttgggacagttttcatctcacaatcagcagtctcgaacctgaagattttgctaacttactactgtcaacagacttacaatatacgagacgttcgtcaaggaccaaggtggagatacaaaacgactagtggactgacaccatcngtctcatctccgccatctg

SEQ ID NO: 324576 - DNA, 509 bp, Homo sapiens
  misc_feature: GZ8MTXP02FZIR1.8.71.G05.1.454.CMB.2.raw
  modified_base (220)..(220): a, c, t, g, unknown or other
  misc_feature (220)..(220): n is a, c, g, or t
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccggngagtcagtccattaacaactattaaattggtatcaacaaaaccagggaaagcccctaaatacctggtctatactgcatccactttgcaaagtgggtcccatcaaggttcagtgcagtgattgggacagtttcactctcacaatcagcagtctcgaacctgaagattttgctaaacttactactgtcaaacagacttaacaatataccgaggacgttcgtacaagggaccaaggtggagatacaaaacgaaactgtaggctgcaccatctgtctcatcttccgcatctag

SEQ ID NO: 324577 - DNA, 557 bp, Homo sapiens
  misc_feature: GZ8MTXP02GCQPN.8.71.G05.1.454.CMB.2.raw
  modified_base (435)..(435): a, c, t, g, unknown or other
  misc_feature (435)..(435): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaccagggaaagacccctaaatacctggtctatactgcatccactttgacaaagtggggtcccatcaaggttcagtggcagtgatttgggactagtttcactctcacaatcagcagtctacgaacctgaagtatttagactaaacttactactagtacaaacagtaacttaanaattataccgagtacgttacgtacaagggaccaagggtagagaatacgaaaacgtaactcgtaggactagaccacctatccgtagtcctttcaacttccgttacccgacctaacgtcctagg

SEQ ID NO: 324578 - DNA, 528 bp, Homo sapiens
  misc_feature: GZ8MTXP02F82TG.8.71.G05.1.454.CMB.2.raw
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcagtcagtccattaacactattaaatgtatcaacaaaacaggaaancccctaaatacctggtctatactgcatccatttgacaaagtcggggtcccatcaaggttcagtggcagtgatttgggactagtttcactctcacatcagcagtctacgaacctgaagtattttgactaacttactactgtacaacagacttacaaatactaccgagtacgttacgtacgaagggaccaaggtaggagaatacgaaaacgtaacgtgtaggctagcaccagtctagtcttcacttctacccgctactcgtag

SEQ ID NO: 324579 - DNA, 518 bp, Homo sapiens
  misc_feature: GZ8MTXP02FPU9A.8.71.G05.1.454.CMB.2.raw
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccggcagtcagtccattaacaactatttaaattggtatcaacaaaaaccagggaaagcccctaaatacctggtctatactgcatccactttgcaaagtgggtcccatcaaggttcagtggcagtgattgggactagttttcactctcacaatcagcagtctcgaaacctgaaagtattttgctaaacttactactgtcaaacagacttacaaatataccgagacgttcggtacaagggaccaaggtggagatacaaaacgaactgtaggctagcaccatctgtcttcatcttccgccatctag

SEQ ID NO: 324580 - DNA, 611 bp, Homo sapiens
  misc_feature: GZ8MTXP02GJB0P.8.71.G05.1.454.CMB.2.raw
  modified_base (604)..(604): a, c, t, g, unknown or other
  misc_feature (604)..(604): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtacaccactctacttcgtccgggccggagtcagtacctacttaactaactaatttaaattaggtatacaacaaaacaaggaagaccctaactaacctggtactatactgcactcctactttagtacgaaacggtaggggtcccgtaactacgtaaaggtttaccgaggtagggtcgagtagggtagtttaggggtacgtagttttactactccttcaacaactacacgacagtacctacgaaccttagaagtacttttgacaaacttacttactagtacaaacagaacttaactaaatataaccgagaacggtttcgtaaccgaagggaaccgaaggtaggacgataacgaaacgaaagtgtggactgacaccatcttagtcttacatccttcccgtaccntacgtcg

SEQ ID NO: 324581 - DNA, 504 bp, Homo sapiens
  misc_feature: GZ8MTXP02JJBXX.8.71.G05.1.454.CMB.2.raw
tcagctcgcgtgtccacgaccggtgctcgatttagtgtcgtcgcaagagagaggggagtcagtctcagtcaggacacagcatggacatgagggtcccgctcagctcctggggctcctgctcctctggctccgaggtgccagttgtgacatccagttgacccagtctccctcctctctgtctgcttctgtgggagacagcgtcaccatcacttgccgggcagtcagtccattaacaactattaaatggtatcaacaaaaccaggaaagcccctaaatacctggtctatactgcatccactttgcaaagtggggtcccatcaaggttcagtggcagtgatttgggactagtttcactctcacaatcagcagtctcgaactgaagatttgcaacttactactgtcaacagacttacaatataccgagtacgttcgtcaagggacaaggtgagatcaaaagaactgtggactggcaccatctagtcttcactcttcccgctactctag

SEQ ID NO: 324582 - DNA, 530 bp, Homo sapiens
  misc_feature: GZ8MTXP02JV0PB.8.71.G05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggnagtcagtccattaacactattaatgtatcaacaaaacaggaagcccctaaatacctggtctatactgcatccactttgcaaagtggggtcccatcaaggttcagtggctagtggatttgggactagttttcactctcacatcagcagtctacgaacctgaagtatttgactaacttactactgtacaacagtacttaacaaatactaccgaggtacgttacggacgaaagggaccaaggtggaagagtacaaaacgtaactggtaggctgaccaccgatctgtcttcactccttcccgcctactctag

SEQ ID NO: 324583 - DNA, 518 bp, Homo sapiens
  misc_feature: GZ8MTXP02HLKPH.8.71.G05.1.454.CMB.2.raw
  modified_base (196)..(196): a, c, t, g, unknown or other
  misc_feature (196)..(196): n is a, c, g, or t
  modified_base (271)..(271): a, c, t, g, unknown or other
  misc_feature (271)..(271): n is a, c, g, or t
  modified_base (450)..(450): a, c, t, g, unknown or other
  misc_feature (450)..(450): n is a, c, g, or t
  modified_base (466)..(466): a, c, t, g, unknown or other
  misc_feature (466)..(466): n is a, c, g, or t
  modified_base (503)..(503): a, c, t, g, unknown or other
  misc_feature (503)..(503): n is a, c, g, or t
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcgagtcagtccattaacaactattaaatggtatcaaacaaaacagggaaanacccctaaatacctggtctatactgcatccactttgacaaaagtgggtcccatcaaggttcagtggcagtggatttgggactagttttcactctcacaatcagcagtctacgaaacctgaaagtatttgactaaacttactaactgtacaacagacttacaatatacgagacgtcgtanaaaggacaaggtgaanatacaaaacgaactgtggctgacaccatctagtcttnactctccgcactcag

SEQ ID NO: 324584 - DNA, 542 bp, Homo sapiens
  misc_feature: GZ8MTXP02GMYBB.8.71.G05.1.454.CMB.2.raw
  modified_base (196)..(196): a, c, t, g, unknown or other
  misc_feature (196)..(196): n is a, c, g, or t
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcagtcagtccattaacaactattaaatggtatcaacaaaacagggaaagcccctaaatacctggtctatactgcatccactttgcaaagtggggtcccatcaaggttcagtggcagtggatttggggactaggttttcactctcacaaatcagcagtctcgaacctgaatattttgctaaacttactactgtacaaacagtaacttacaaataattacccgaggtacggtttcggtacgaaaggggacccaaagggtggaagatacgaaaacgaactgtaggctagcacgactactgtcttcactcttcccgcctatctacg

SEQ ID NO: 324585 - DNA, 531 bp, Homo sapiens
  misc_feature: GZ8MTXP02GV5VR.8.71.G05.1.454.CMB.2.raw
  modified_base (197)..(197): a, c, t, g, unknown or other
  misc_feature (197)..(197): n is a, c, g, or t
  modified_base (441)..(441): a, c, t, g, unknown or other
  misc_feature (441)..(441): n is a, c, g, or t
  modified_base (461)..(461): a, c, t, g, unknown or other
  misc_feature (461)..(461): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttggccgggcgagtcagtccaattaacaactatttaaattggtatcaacaaaaccagggaaacgacccctaaatacctggtctatactgcactccactttgactaaaaggtggggtcccatcaaggttcagtggcagtggatttgggactagttttcactctcacatcagcagtctacgaacctagaagtattttgactaaacttactactagtacaacagaacttanaatatacgagtagttacganaagggaccaggtagagatacaaacgaactgtgctgacacgatactgtcttcatccttccgctactctacg

SEQ ID NO: 324586 - DNA, 536 bp, Homo sapiens
  misc_feature: GZ8MTXP02I4Z1D.8.71.G05.1.454.CMB.2.raw
  modified_base (197)..(197): a, c, t, g, unknown or other
  misc_feature (197)..(197): n is a, c, g, or t
  modified_base (268)..(268): a, c, t, g, unknown or other
  misc_feature (268)..(268): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccggcagtcagtccattaacaactattaaattgtatcaacaaaacagggaanaccctaaatacctggtctatactgcatccactttgcaaagtgggtcccatcaagttcagtggcagtgatttgggactagtttcactctcacaatcagcagtctacgaacctgaagtattttgactaacttactactgtacaacagacttacaatatacgagtacgttcgtacgaagggacaaggtcggaagatacgaaaacgtacgtagtggactacggacacctaacgtctacgttcttactacttccttcccgtactacttactag

SEQ ID NO: 324587 - DNA, 545 bp, Homo sapiens
  misc_feature: GZ8MTXP02JO3PA.8.71.G05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggngagtcagtccattaacaactattaatgtatcaacaaaaccagggaaacacccctaaatacctggtctatactgcactccactttgactaaaggtcggggtacccatcaaggttcagtggcaggtggatttgggactagttttcactctcacaatcagcagtcctacgaacctgaaagtattttagactaaacttactactgtacaacagtacttacaaatataccgaggtacgttacggtacaagggaccaagggtgaagatacgaaaacgactggagctagacaccgactctagtctcactccttacccgctacgtctacgg

SEQ ID NO: 324588 - DNA, 525 bp, Homo sapiens
  misc_feature: GZ8MTXP02FWD2I.8.71.G05.1.454.CMB.2.raw
  modified_base (197)..(197): a, c, t, g, unknown or other
  misc_feature (197)..(197): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcagtcagtccattaacaactatttaaattggtatcaacaaaaaccagggaaagcccctaaatacctaggtctatactgcatccactttgcaaagtggggtcccatcaaggttcagtggcagtgatttgggactagtttcactctcacaatcagcagtctcgaacctgaacgattttgactaaacttactactgtacaaacagtaacttaacaaatactaaccgaggtacgttcgtacaagggaccaaggtggagatacaaaacgaactgtagctgacacatctgtctcatctccgcactctacg

SEQ ID NO: 324589 - DNA, 559 bp, Homo sapiens
  misc_feature: GZ8MTXP02HDT8L.8.71.G05.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (433)..(433): a, c, t, g, unknown or other
  misc_feature (433)..(433): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccggnagtcagtccattaacaactattaatgtatacaacaaaacaggaacgacccctaaatacctgtactatactgcactccactttgactaaaaggtcggggtaccccatacaaggttcaggtggacagtggtatttgggactagttttcactctcacatcagcagtctacgaactgaatatttgactaacttactactgtacaacagtaacttanaaatacgtacgaggtacgttacggtacgaagggaccgtaagggtaggagaatacgaaaacgtaacgtggtgacgtacgacacctatcgttagttccttactacttccttaccacgtccctaatccg

SEQ ID NO: 324590 - DNA, 533 bp, Homo sapiens
  misc_feature: GZ8MTXP02HGJN7.8.71.G05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (465)..(465): a, c, t, g, unknown or other
  misc_feature (465)..(465): n is a, c, g, or t
  modified_base (519)..(519): a, c, t, g, unknown or other
  misc_feature (519)..(519): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggnagtcagtccattaacaactattaatgatcaanaaaaccngggaaancccctaaatacctggtactatactgcatcactttgcaaagtgggtcccatcaaggtcagtgcagtgattgggactagtttcactctcacaaatcaagcagtctacgaacctgaagtattttgactaacttacactgtacaaacagtaacttacaaatataccgaggtacgtttacgacaaagggtaccaaaggtganagtacaaaacgtaactggtggacctaggcaaccatctgtctacactcttacccncctaatccgtaagg

SEQ ID NO: 324591 - DNA, 534 bp, Homo sapiens
  misc_feature: GZ8MTXP02HGKEM.8.71.G05.1.454.CMB.2.raw
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactattaaatggtatcaacaaaaacagggaaagcccctaaatacctggtctatactgcatccactttgcaaagtggggtcccatcaaggttcagtggcagtggatttgggactagttttcactctcacaatcagcagtctcgaaacctgaaagtattttgactaaacttactactgtacaacagaactttacaaatattaaccgagtacgttacgtacgaaagggaccaagggtggagaatacgaaaacgaactgtaggctaggcaccatctgtcttcactcttcccgcactctacg

SEQ ID NO: 324592 - DNA, 611 bp, Homo sapiens
  misc_feature: GZ8MTXP02GA2HC.8.71.G05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttggccggnagtcagtccattaacatattaatgtatacaaacaaaacaggaaacgacccctaaatacctggtactatactgctatcctactttgactaaaggtcggggtacccatacaaaggttcagtggcagtggtatttgggactagtttcactctcacatcagcagtctacgaactagaagtattttagactaaacttctactacgtacaaacagtaacttaacaaattactaacccgaggtaccgttacggtaccgaaacggggtaacctaagggtacggaagaaacgtaacgaaaaaccggtaacttaggttacggaccgttacggaccaacccgtaatccgttaacgttccgttacctaacgttcccttacccccgactaaccgtctaacgg

SEQ ID NO: 324593 - DNA, 559 bp, Homo sapiens
  misc_feature: GZ8MTXP02GBQW1.8.71.G05.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctgtggganacagcgtcaccatcacttgccgggnagtcagtccaattaacaactatttaaattggtaatacaaacaaaaaccagggaaacgacccctaaaatacctggtactaatactgctatccactttgactaaaaggtggggtaccccaatacgaaaggtttcagtggcagtggtatttggggactagtttcactctacacaatcagacagtctacgaacctagaatattttgactaaacttactactgtacaaacagtaacttaacaatatacgaggtacgtcgtacaaggacaaggtagagatacgaaaacgactgtagctagactacactcgtatcttcacttccttcccgactacgtctaagg

SEQ ID NO: 324594 - DNA, 522 bp, Homo sapiens
  misc_feature: GZ8MTXP02GI8Q8.8.71.G05.1.454.CMB.2.raw
  modified_base (368)..(368): a, c, t, g, unknown or other
  misc_feature (368)..(368): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactattaaattggtatcaacaaaaccagggaaagcccctaaatacctggtctatactgcatccactttgcaaagtgggtcccatcaaaggttcagtggcagtggatttggggactagttttcactctcanaaatcagcagtctacgaacctgaagattttgactaacttactactgtacaaacagaacttacaaatactacgagtacgttgtacaagggacaaggtgagatacaaacgaatgtaggactgacaccatctgtcttcgactcttccgcacttcacg

SEQ ID NO: 324595 - DNA, 722 bp, Homo sapiens
  misc_feature: GZ8MTXP02IDX0H.8.71.G05.1.454.CMB.2.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctggtggganacagcgtcaccatcacttggccgggngagtcagtccaattaaacaacttaatttaaattggtaatacaaacaaaaaccagggaaacgacccctaaatacctaggtactatactgacatccactttgactaaaaggtcggggtaccctatacgtaaaggttcaaggtggactaggtggtagtttggggtacttaggtttttcacttctctaaactaaactcaagtcaagttcctacgtaaccgtagaacgttattttcgactaaactttactaacttagtacctaaactaagtaacctttaaactaaaacttacgttaaacccggtaagggttaaccggtttacccggggttaacgaaaacgggggtaacccgtaaaagggggttaggaacggtaagttaaacccgaaaaaaccggtaaccgttagggtacggggtacctacggtacccaaacccgtacttaccgttcggttaacctttacgtaactttccccgttacccccgtacctaactttcccgtaacgg

SEQ ID NO: 324596 - DNA, 572 bp, Homo sapiens
  misc_feature: GZ8MTXP02JFOTM.8.71.G05.1.454.CMB.2.raw
  modified_base (196)..(196): a, c, t, g, unknown or other
  misc_feature (196)..(196): n is a, c, g, or t
  modified_base (420)..(420): a, c, t, g, unknown or other
  misc_feature (420)..(420): n is a, c, g, or t
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcagtcagtccattaacaactattaaatggtatacaacaaaaccaggaaagacccctaaatacctggtctatactgcatccactttgcaaagtgggtcccatcaaggtcagtggcagtgatttgggactagtttcactctcacaatcagtcagtctacgaacctgaagtatttgactaattactactgtcaacagacttanaaatatacgaggacgttacgtacgaaggaccaaggtacggagaagtacgaaaacgaactagtagggtactacggacaccctaagttaccctgtttaaccgttaccgtaacgtttacccgtttaccccccgtacccgtaacgttaccgtacgg

SEQ ID NO: 324597 - DNA, 558 bp, Homo sapiens
  misc_feature: GZ8MTXP02G14EM.8.71.G05.1.454.CMB.2.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcaccatcacttgccgggnagtcagtccattaacaactattaatgtatacaaacaaaacaggaacgaccctaaatacctgtctatactgcatccactttgactaaaggtcggggtacccatactaaggttcagtggcaggtggagtttggactagtttacactctacaacaatcagtcagtctacgaactagaacgtatttcgacttaaacttactacttacgtacaaactataacttaacaatacgtaaccgaggtacgttacggtacgaaacgggtaccaaggtggaagtagacaaaacgtacgtggtagactagacaccagtctagtcttcacttctacccgctactcgtacg

SEQ ID NO: 324598 - DNA, 564 bp, Homo sapiens
  misc_feature: GZ8MTXP02GTYNW.8.71.G05.1.454.CMB.2.raw
  modified_base (197)..(197): a, c, t, g, unknown or other
  misc_feature (197)..(197): n is a, c, g, or t
  modified_base (269)..(269): a, c, t, g, unknown or other
  misc_feature (269)..(269): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcgagtcagtccattaacaactattaatgtatcaacaaaacagggaaanacccctaaatacctaggtctatactgcatccactttgacaaagtgggtcccatcaagttcagtggcagtgatttgggactgtttcactctcacatcagcagtctcgaacctgaagtattttagactaaacttacctactagtacaactagtaaccttacaaatactaaccgaggtacgttacggtaccgaaaggggtaccaaagggttgggaagtagtaacgaaaacgtaaacgtaggtaggacgtggactaccgactctcgtaacttcacttccttcccgacctactacgtacg

SEQ ID NO: 324599 - DNA, 639 bp, Homo sapiens
  misc_feature: GZ8MTXP02H87H7.8.71.G05.1.454.CMB.2.raw
  modified_base (198)..(198): a, c, t, g, unknown or other
  misc_feature (198)..(198): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctctctggctccgaggtgccagttgtgacatccagttcgacccagtcctccctctctctgtctgcttctggtggganacagcgtcaccatcacttggccgggcagtcagtccattaacaacttattaatgtatacaaacaaaacgaggaaacgaccctaaatacctgtactatactgactactcctactttgactaaacggtcggggtacccatacgtaaaggttcaggtggcgtaggtaggtagtttgggacttagttttcacttctactaacaatacagctatcctaccgtaaacctagtaacgttatttacgacttaaacttactactacgtacaaacgtactaaacttaactaaattacgtaaccgtaagggttaccggttacggtaacggtaaacgggaaccgaaagggtacggaagtaacgtaacgaaaacgtacgtaggttacggactacggacctacctacgttctacgttccttactaacttcccgttaccccgactaacttcgtacgg

SEQ ID NO: 324600 - DNA, 579 bp, Homo sapiens
  misc_feature: GZ8MTXP02JB133.8.71.G05.1.454.CMB.2.raw
  modified_base (274)..(274): a, c, t, g, unknown or other
  misc_feature (274)..(274): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaatggtatacaacaaaaccagggaaancccctaaatacctggtactatactgcatccactttgacaaagtgggtacccatcaaggtacagtggcgagtggtagtttgggtacgtagtttacgtactctcaacaatacagcagtctacgactagaagtactttgtactaacttacttactagtacaacagtaaacttaactaaatacttaaccgaacgggtacggttaccggtacgtaaacgggaaccgtaaagggtaggaggaatacgaaaacgaacgtagtaggacgtagactaccactctacgtcttcacttccttcccgcctactctag

SEQ ID NO: 324601 - DNA, 542 bp, Homo sapiens
  misc_feature: GZ8MTXP02I1FR6.8.71.G05.1.454.CMB.2.raw
  modified_base (196)..(196): a, c, t, g, unknown or other
  misc_feature (196)..(196): n is a, c, g, or t
  modified_base (267)..(267): a, c, t, g, unknown or other
  misc_feature (267)..(267): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcaccatcacttgccggcgagtcagtccattaacactattaaatgtatacaacaaaacaggaaanccctaaatacctggtactatactgcatccactttgcaaagtgggtcccatcaaggttcagtggcagtgatttggactagtttcactctcacaatcagacagtctacgaacctgaaagtattttagactaaactttacctaactgtacaaacacgtaacttaacaaatacgtaccgaggtacgttacgtacaagggaccaagggtaggagaactacgaaaacgtaactgtggactgacacctaatcctagtcttcacttcctcccgctactcctag

SEQ ID NO: 324602 - DNA, 540 bp, Homo sapiens
  misc_feature: GZ8MTXP02HXJB7.8.71.G05.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (385)..(385): a, c, t, g, unknown or other
  misc_feature (385)..(385): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctcccctcctctctgtctgcttctggtggganacagcgtcaccatcacttgccgggngagtcagtccattaacaactattaaatgtatacaaacaaaaccagggaaacacccctaaatacctaggtactaatactgactactcctactttgacaaaggtcggggtacccatcgaaaggttcagtggacagtggtatttgggactagtttcactctcanatcagcagtctacgaactgaagtatttgacttaacttactactgtacaacataacttacaatactacgaggtacgttgtacgaaggacaaggtgaagatacgaaaacgactagtggactgacacatctgtcttcacgttctacccgctacttcag

SEQ ID NO: 324603 - DNA, 516 bp, Homo sapiens
  misc_feature: GZ8MTXP02F1ZAF.8.71.G05.1.454.CMB.2.raw
  modified_base (197)..(197): a, c, t, g, unknown or other
  misc_feature (197)..(197): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcagtcagtccattaacaactattaaattgtatcaacaaaaccaggaaagccctaaatacctggtctatactgcatccactttgcaaagtgggtcccatcaaggttcagtggcagtggattggggactagtttcactctcacaatcagcagtctacgaacctgaagtattttgactaacttactactgtacaaacagtaacttacaaatactaccgagacgttgtacaaggaccaaggtgagaatacaaacgaactgaggctgacacatctagtcttcactctcccgcactctacg

SEQ ID NO: 324604 - DNA, 605 bp, Homo sapiens
  misc_feature: GZ8MTXP02G1QML.8.71.G05.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (445)..(445): a, c, t, g, unknown or other
  misc_feature (445)..(445): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgaaatccagttgacccagtctccctcctctctgtctgcttctggtggganacagcgtcaccatcacttgccgggnagtcagtccattaacaattattaaatggtatcaaacaaaaccaggaaacacccctaaatacctaggtactatactgacatccactttgacaaagtcgggtacccatcaaggttcagtggctagtggtattgggactagttttcactctcacaatcagcagtcctacgaaacctgaaagtatttagactaaacttactactagtacaaactagaactttaaanaaattaactaaccgtaaggtaccgttcgggtaacaaaggggacctaaagggtagaacgtaataaccgaaaacggtaactaggtacggactacggaccaacccgtattccgtacgttacttaaccgtacttccctttaccccgctaacttcgtacgaaccg

SEQ ID NO: 324605 - DNA, 641 bp, Homo sapiens
  misc_feature: GZ8MTXP02J04AK.8.71.G05.1.454.CMB.2.raw
  modified_base (199)..(199): a, c, t, g, unknown or other
  misc_feature (199)..(199): n is a, c, g, or t
tcagctcgcgtgtccacgaccggtgctcgatttagtgtcgtcgcaagagagaggggggagtcagtctcagtcaggacacagcatggacatgagggtcccccgctcagctcctggggctcctgctcctctggctccgaggtgccagttgtgacatccagttgacccagtcctccctcctctctgtctgcttctgtggganacagcgtcaccatcacttgccgggcgagtcagtccattaacaacttatttaattgtatacaaacaaaaccgagggaaacacccctaaatacctggtactatactgcatcctactttgacaaaggtcgggtacccatccgaaaggttccaggtggcagtggtatttggggactaggttttcactcgtacaactaatcacgctaggttacctaccgtaaaccttagttactttgaacctaacttactactacgtacaacagtacttaaacaattacgaacggtaggtacgttaccgggtaacgaaacggaccgtaaagggtcggaagtaacgtaacgaaaacgtaactggtacgggtacacggtacctaaccgtacttaccgttcggttactttccgtaaacttccccgtttccccggacctactttaccgtacggaacccggg

SEQ ID NO: 324606 - DNA, 524 bp, Homo sapiens
  misc_feature: GZ8MTXP02IS8M3.8.71.G05.1.454.CMB.2.raw
  modified_base (266)..(266): a, c, t, g, unknown or other
  misc_feature (266)..(266): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccggcgagtcagtccattaacaactattaatgtatcaacaaaacaggaanccctaaatacctgtctatactgcatccacttgcaaagtgggtacccatcaaggttcagtggcagtgatttggactagtttcactctcacaatcagcagtctacgaacctgaatatttagactaaacgttactactagtcaaacagtacttaacaatactacgaggtacgttacgacgaacgggacctaagggtacgagatacgaaaacgtacgtgtaggctagacacactactgtctcacttctccgactatactacg

SEQ ID NO: 324607 - DNA, 536 bp, Homo sapiens
  misc_feature: GZ8MTXP02JFAN7.8.71.G05.1.454.CMB.2.raw
  modified_base (266)..(266): a, c, t, g, unknown or other
  misc_feature (266)..(266): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacactattaatgtatacaacaaaacaggaanaccctaaatacctaggtctatactgcatccacttgacaaaggtggggtcccatcaaggttcagtggcagtggatttgggactagttttcactctcaacaatcagcagtctacgaacctgaacgtattttagactaaactttactacttgtacaaacagtaaccttaacaaatactaccgaggtacgttcgtacgaagggaccaagggtgagatacgaaaacgactggtgctgacacatctagtcttacacttccttcccgctactctacg

SEQ ID NO: 324608 - DNA, 531 bp, Homo sapiens
  misc_feature: GZ8MTXP02JXKLN.8.71.G05.1.454.CMB.2.raw
  modified_base (197)..(197): a, c, t, g, unknown or other
  misc_feature (197)..(197): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcagtcagtccattaacaactattaaatggtatcaacaaaacaggaacgcccctaaatacctggtctatactgcatccactttgactaaaggtcggggtacccatcaaggttcagtggcagtgatttgggactagtttcactctacacaatcagcagtctacgaaccttagaagtatttgactaacttactactgtacaacagacttaacaatactaccgaggacgttcggtacaaagggaccaaggtcgagatacaaaacgtactagtacggactgacaccagtctgtctcactccttccgctactctag

SEQ ID NO: 324609 - DNA, 541 bp, Homo sapiens
  misc_feature: GZ8MTXP02H6C61.8.71.G05.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (443)..(443): a, c, t, g, unknown or other
  misc_feature (443)..(443): n is a, c, g, or t
  modified_base (489)..(489): a, c, t, g, unknown or other
  misc_feature (489)..(489): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctggtggganacagcgtcaccatcacttgccgggngagtcagtccattaaacaacttaatttaaattgtatacaaacaaaaaccgaggaaacgacccctaaatacctgtactaatactgactatcctactttgactaaaggtcgggtacccatcaaaggttcagtgcagtggtatttgggacttagtttcactctcacaatcagcagtctacgaactgaagtatttcgacttaaacttactactagtacaacanaacttacaaataactaccgagtacgttcgagagggacaggtagaanatacaaaacgactgtagctgacaccntctntctctactcctaccnctatcng

SEQ ID NO: 324610 - DNA, 625 bp, Homo sapiens
  misc_feature: GZ8MTXP02H4JVJ.8.71.G05.1.454.CMB.2.raw
  modified_base (200)..(200): a, c, t, g, unknown or other
  misc_feature (200)..(200): n is a, c, g, or t
  modified_base (303)..(303): a, c, t, g, unknown or other
  misc_feature (303)..(303): n is a, c, g, or t
tcagctcgcgtgtccacgaccggtgctcgatttagtgtcgtcgcaagagagaggggggagtcagtctcagtcaggacacagcatggacatgagggtccccgctcagctcctggggcctcctgctcctctggctccgaggtgccagttgtgacatccagttcgacccagtcctccctcctctctgtctgcttctggtgganacagcgtcaccatcacgttcggccgggcgagtcagtccaattaacaacttattaatggtatacaaacaaaacgaggaaacaccctaaatacctgtactatacngacatcctattagactaaaggtcgggtacccatacgtaagtcaggtggacagtggtagtttggacttagtttcacgtctactaacatcagctacgtactacgaaccagtaatatttagacttaacttactactagacctactaagtaacttaactaaataacgtacggtaggtaccgggttacggtaacggtaaacgggaccgtaaggggtaggaaacgtaacgtaaccgaaaacggtacgtacggtcgggactacggacctacctagtccttacggttaaccttctaaccttcccgtccccgtacctaactttccgaacgg

SEQ ID NO: 324611 - DNA, 624 bp, Homo sapiens
  misc_feature: GZ8MTXP02J2F4J.8.71.G05.1.454.CMB.2.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (273)..(273): a, c, t, g, unknown or other
  misc_feature (273)..(273): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctgtggganacagcgtcaccatcacttgccggnagtcagtccattaacaactattaattgtatacaaacaaaaccagggaaacncccctaaatacctggtctatactgcatccactttgacaaaggtcgggtacccatcaaggttcagtggcagtgtagtttgggactagtttcactctcacaatcagcagtctacgaacctgaagtatttagactaacttactactcgtacaactaagtacttaacaaatacgtaccggtaagggtaaccggtttacggtacgaaacggggtaacctaaaggggttaggaacgtaacgtaacgaaaacgtaacgtacggttacgggacctacggacctaccgtaacgttccgttacggttaaccctttacgtaactttccccgtttacccccggccttaaacttcccgtaacgg

SEQ ID NO: 324612 - DNA, 572 bp, Homo sapiens
  misc_feature: GZ8MTXP02JNRUI.8.71.G05.1.454.CMB.2.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcaccatcacttgccgggnagtcagtccaattaacaacttatttaaattgtatacaaacaaaaccagggaaacacccctaaatacctggtactatactgctactccactttgactaaaggtcggggtacccataccaaggttcaggtggctagtgtatttgggacttagtttcactctacactaatcagcagtcacgaacctgaatatttgactaacttactatgtacaatataacttacaatactacgaggtacgttacggacaaggaccgaaggtgagtactacgaaaacgtactaggtacggactgacctaacgacttccgtgttaaccttacgacctttccgttacccccgacttactcgtaacgg

SEQ ID NO: 324613 - DNA, 637 bp, Homo sapiens
  misc_feature: GZ8MTXP02JGW5Y.8.71.G05.1.454.CMB.2.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcaccatcacttgccgggnagtcagtccattaacactattaatgtatcaanaaaacaggaacaccctaaatacctgtactatactgacatccactttgactaaaggtcggggtacccatacgaagttcagtgcagtgtattggactagtttcactctacacaactcagtacacttctacgaaccttagaaacgttattttagacctaaacttacctacgtagtacaaactaacgtaaccttaaacaaattaacgtaaccgtacgggtaacggtttaccggaacgaaacgggggaacctaaaggggtaggaaggtacttaaacgaaaacggtaacgtggtacggacgttacggtaccaacccgtagttccttacggttaacctttaccgtaaaccgtttcccgttcccccgtacccgttaacttacccgtaaacgg

SEQ ID NO: 324614 - DNA, 559 bp, Homo sapiens
  misc_feature: GZ8MTXP02IOXK1.8.71.G05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagctcgcgtgtccacgaccggtgctcgatttagtgtcgtcgcaagagagaggggggagtcagtctaagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggnagtcagtccattaacactattaaatggtatcaacaaaacaggaaagccctaaatacctggtctatactgcatccactttgacaaagtgggtcccatcaaggttcagtggcagtggattggactgttttcacttctcacaatcagcagtctcgaaacctgaaagtatttgacaacttactactgtacaacagaacttacaaatactaaccgtaggtacgttcggtacgaaagggaccgtaaaggtcgaagtatacgaaaacgaacgtggtacggtactacgacgacctacgtacttcgtacttaacgacttaccttcccgacctactcgtacgaaccg

SEQ ID NO: 324615 - DNA, 542 bp, Homo sapiens
  misc_feature: GZ8MTXP02FQ1M8.8.71.G05.1.454.CMB.2.raw
  modified_base (223)..(223): a, c, t, g, unknown or other
  misc_feature (223)..(223): n is a, c, g, or t
  modified_base (397)..(397): a, c, t, g, unknown or other
  misc_feature (397)..(397): n is a, c, g, or t
  modified_base (418)..(418): a, c, t, g, unknown or other
  misc_feature (418)..(418): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctggtgggagacagcgtcaccatcacttgccgggnagtcagtccattaacaatattaatgtatacaaacaaaaccgaggaacaccctaaatacctgtactatactgcatcctatttgactaaaggtcgggtacccatacgtagttcagtgctagtgtattgggactagtttcactctacactatcagcacgtctacgaaacctgaagtntttagacttaaactcctaatntacaaatactaaacttacaaattacgtaccgaggtaaccgttggaacgaagggacaaggtggagatacaaacgtactggtgactagacacctatctactaactctactccgttcccatctctag

SEQ ID NO: 324616 - DNA, 531 bp, Homo sapiens
  misc_feature: GZ8MTXP02JR84P.8.71.G05.1.454.CMB.2.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcaccatcacttgccgggnagtcagtccattaacaactattaaattgtatcaacaaaacaggaaagcccctaaatacctggtctatactgcatccactttgcaaagtggggtcccatcaaggttcagtggcagtggatttgggactagttttcacttctcacaatcagcagtctacgaacctgaagtattttgctaaacttactactgtacaaacagtaacttacaaattataccgaggtacgttacgtacaaggggaccaaggtaggagatacgaaaacgtactgtaggctagacaccgactctgtcttcactcttccgcctatctag

SEQ ID NO: 324617 - DNA, 612 bp, Homo sapiens
  misc_feature: GZ8MTXP02IND66.8.71.G05.1.454.CMB.2.raw
  modified_base (197)..(197): a, c, t, g, unknown or other
  misc_feature (197)..(197): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttggccgggcgagtcagtccaattaacaacttattaaatgtatacaaacaaaaaccaggaaacaccctaaatacctggtactatactgcatccactttgacaaagtcggggtacccatacaaggttcagtggcagtgtagttggactagtttcactctacacaatcagcacgttctacgaactgtaaagtatttagacttaaacttactactgtaacaaacagtaacttaacaaaatacgtaaccgaaggtacgttaccggaacgtaaacgggaaccgaagggtacggaagtaaactaacgaaaaacggtaactagggtcggtacctacgacctaacccgtaattccttacggttccttacctacgtttcccttaacccccgtactaacgttcgtaacg

SEQ ID NO: 324618 - DNA, 546 bp, Homo sapiens
  misc_feature: GZ8MTXP02JPG07.8.71.G05.1.454.CMB.2.raw
  modified_base (266)..(266): a, c, t, g, unknown or other
  misc_feature (266)..(266): n is a, c, g, or t
  modified_base (303)..(303): a, c, t, g, unknown or other
  misc_feature (303)..(303): n is a, c, g, or t
  modified_base (536)..(536): a, c, t, g, unknown or other
  misc_feature (536)..(536): n is a, c, g, or t
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtcctccctcctctctgtctgcttctgtgggagacagcgtcaccatcacttgccgggcagtcagtccattaacactattaatgtatcaacaaaacaggaaanacccctaaatacctaggtctaatactgcatccatttncaagtgggtcccatcaagtcagtggcagtgatttggactagtttcactctcactaatcagcagtctacgaacctgaaagtattttcgactaaacttactactgtaccaaactagtaacttaacaaattaatacccgaaggtacgttacggtacaaacgggtaccaaagggtgagtatacgaaaacgtacgtagaggctacgcctaccgatcctgtccttacattccttacccnctaactcacg

SEQ ID NO: 324619 - DNA, 562 bp, Homo sapiens
  misc_feature: GZ8MTXP02FPAJ7.8.71.G05.1.454.CMB.2.raw
  modified_base (197)..(197): a, c, t, g, unknown or other
  misc_feature (197)..(197): n is a, c, g, or t
  modified_base (383)..(383): a, c, t, g, unknown or other
  misc_feature (383)..(383): n is a, c, g, or t
  modified_base (448)..(448): a, c, t, g, unknown or other
  misc_feature (448)..(448): n is a, c, g, or t
  modified_base (471)..(471): a, c, t, g, unknown or other
  misc_feature (471)..(471): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcagtcagtccaattaacaacttatttaaattggtaatacaaacaaaaaccagggaaacgaccccctaaatacctggtactatactgcatcctactttgactaaaggtcggggtacccatcgaaggttcagtggcagtgtatttgggacttagtttcacttcncactaatcagcagtctacgaactgaagtatttagactaacttactactgtacaacagtaactaanaatactacgaggtacgttacganaacgggacaagggtagagaatacgaaaacgtaacgtggtagcgtagaccactactcttgtccttacattccctaccgcctaagtcctaagg

SEQ ID NO: 324620 - DNA, 616 bp, Homo sapiens
  misc_feature: GZ8MTXP02GQO34.8.71.G05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtctccctctctctgtctgcttctgtggganacagcgtcaccatcacttggccggnagtcagtccaattaacaacttaatttaaattggtatacaaacaaaaacagggaaacacccctaaataccgtaggtactatactagctactcctactttgactaaaggtcgggtacccatacgaaggttcagtggctaggtaggtatttgggacttacgtttacacttctacaactatacagctagtacctacgaaaccttaggaaagtacgtttagacctaaacttactactatacaaacagtaacttaacaaatactaaccgtaggtaccggtttacgacgaaagggtaccgaaagggtacgaagaactaacgaaaacgacgtaggtacgacgtacgactaacccgattctacgttaacttcctaacttcccttacccactaacttcgtaacg

SEQ ID NO: 324621 - DNA, 642 bp, Homo sapiens
  misc_feature: GZ8MTXP02GC85O.8.71.G05.1.454.CMB.2.raw
  modified_base (457)..(457): a, c, t, g, unknown or other
  misc_feature (457)..(457): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtcctccctcctctctgtctgcttctggtgggagacagcgtcaccatcacttgccgggcagtcagtccaattaacaactatttaaatgtatacaaacaaaaacagggaaacacccctaaatacctggtactatactgcatcctactttgacgtaaaaggtcggggtacccatcgtaaaggttcagtggcagtgtatttgggactagtttcactctacaactaatcagctagtctacgaactgaagtatttgactaaacttactatacgttaccaaaacagtaaacttaaanaaacgttaactaaccgggaaggttaccggttaccggtaaaccgtaaacggggaaaccgtaaaggggtacggaagtaacgttaaacgaaaaccggtaacgttacgggtaggacgttacgaccgaaccctaactccgtttaggtcccttactaacgtttcccttaccccgacctacttacgtaacgg

SEQ ID NO: 324622 - DNA, 586 bp, Homo sapiens
  misc_feature: GZ8MTXP02JNX01.8.71.G05.1.454.CMB.2.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (372)..(372): a, c, t, g, unknown or other
  misc_feature (372)..(372): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctgtggganacagcgtcaccatcacttgccggngagtcagtccattaacaactattaatgtatacaaacaaacaggaaacacccctaaatacctgtactatactgcatccactttgactaaaggtcgggtacccatacgaaggttcagtggcagtggtagtttggactagtttcactctacanatcagcagtctacgaactgtaagtatttagactaacttactactcgtacaactaagtacttaactaaataacgtaccgaggtaccgttacggtacaaacggggaaccaaggggtagaagtacgtaacgaaaacgtacgtagtaggacgtacgaccgtaaccacgttacctacgttccttactacttcccttacccgacctacgtttactaacgg

SEQ ID NO: 324623 - DNA, 587 bp, Homo sapiens
  misc_feature: GZ8MTXP02JL0QU.8.71.G05.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (274)..(274): a, c, t, g, unknown or other
  misc_feature (274)..(274): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccggnagtcagtccattaacaacttattaaattggtatacaaacaaaaccagggaaanacccctaaatacctgtactatactgactactccatttgacaaaaggtcggggtacccatacaaggttcagtggcagtggtatttgggactagtttcactctacaacatcagcagtctacgacctagaagtatttgactaacttactactagtaccaaactagtaacttaacaaacttaacgtaccgaaggtaccggttacggtacgtaaacgggaacctaaaggggtacgaagtaactacgaaaacgtaacgtggtaggctggactaccagttactcgttaacttctacttccgtaccctctaactcgtaacg

SEQ ID NO: 324624 - DNA, 805 bp, Homo sapiens
  misc_feature: GZ8MTXP02FEA39.8.71.G05.1.454.CMB.2.raw
  modified_base (197)..(197): a, c, t, g, unknown or other
  misc_feature (197)..(197): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctgtgganacagcgtcaccatcacttggccgggcagtcagtccaattaaacaactaatttaaattggtaatacaaacaaaaaccgagggaaacacccctaaatacctggtactatactgcactcctatttgacgtaaacggttcggggtaccccaagtacgtaaaggtttcaaggtcggacgtaggttgggtagtttacggggaacttacggtttttaccaactttcctaccaaacctaaaattccgaacggtacctaaacggtttacccttaaacccgtaaaacccgtttaggttaaaacggttaatttttttacggaaccctttaaaaccgtttaaccgttaaaccttacggttaaccaaaacctaacggttaaaaccttttaaaccaaaagtttaaccgtaaacccggggtaacgggtttaaacccggggttttaccggggtaacccgtaaaacgggggaaccccgtaaaagggggttcgggtaaaagaaacgttaaaccgaaaaaaccggtaccgttagggttcgggacccttaggaccctaaaccctaattcctttacggttccctttaccaacttccccgtttacccccgacctaacttcccgtaaacgg

SEQ ID NO: 324625 - DNA, 536 bp, Homo sapiens
  misc_feature: GZ8MTXP02H5M79.8.71.G05.1.454.CMB.2.raw
  modified_base (223)..(223): a, c, t, g, unknown or other
  misc_feature (223)..(223): n is a, c, g, or t
  modified_base (367)..(367): a, c, t, g, unknown or other
  misc_feature (367)..(367): n is a, c, g, or t
  modified_base (503)..(503): a, c, t, g, unknown or other
  misc_feature (503)..(503): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctcccctcctctctgtctgcttctgtgggagacagcgtcacatcacttgccgggnagtcagtccataacactatttaaattgatatacaaacaaaaccagggaaacgacccctaaaatacctggtactatactgacatccactttgactaaagtggggtcccatcaagttcagtggccagtgagttaggactagtttcnctctacacatcagcagtctacgaacctgaagtatttgactaacttactactagtacaacagtaacttaacgaattactaccggaggtacgttacggacgaagggacaaggtgagatacgaaacgactgtacgctancacactctgtcttacgactctcccgactactcg

SEQ ID NO: 324626 - DNA, 638 bp, Homo sapiens
  misc_feature: GZ8MTXP02FK2ZY.8.71.G05.1.454.CMB.2.raw
  modified_base (225)..(225): a, c, t, g, unknown or other
  misc_feature (225)..(225): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtcctccctcctctctgtctgcttctggtgggagacagcgtcaccatcacttggccggngagtcagtccaattaacaactatttaatgtatacaaacaaaacaggaacaccctaatacctgtactatactgacatcctactttgacgtaaaggtcggggtaccctatacgtaaggttcaggtggcaggtggtagttgggacttagtttaccactcctacactaatcacgtacacgtactacgtaacctaggtaaagttacttttacgaaccttaaactttaacctacgttacgttaccaaaacgtacgtaaaccttaacaaattaccgttaaccggtacgggttacgtttacgggaaccgaaaggggtacccgaagggtagggaagtactaacgaaaacgtaacgtggacggtactaggacctaccgtactccgttagtccgttactctaccgttccccactactcgtacgg

SEQ ID NO: 324627 - DNA, 610 bp, Homo sapiens
  misc_feature: GZ8MTXP02FQP5B.8.71.G05.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctgtggganacagcgtcaccatcacttgccgggngagtcagtccaattaacaactatttaaattggtatacaaacaaaaaccagggaaacgacccctaaatacctggtactatactgcatccactttgacaaagtgggtacccatcaagtcagtggcagtggattgggactagtttcactctcacaatcagctagtctacgaacctaggaatattttagactaacttactactgtacaaacgagtaacttaacaaattacgtaccgtaggtacggtttacggacgtaaagggaccgaaagggtaggtaacgtaagtaacgaaaaccgtaacgtaggtacggtacttacggaacctaccgtactaccgttagtccgtttacaacctttcccgttaccccggtacctaactttcccgtaacgg

SEQ ID NO: 324628 - DNA, 549 bp, Homo sapiens
  misc_feature: GZ8MTXP02GPUZ6.8.71.G05.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (268)..(268): a, c, t, g, unknown or other
  misc_feature (268)..(268): n is a, c, g, or t
  modified_base (463)..(463): a, c, t, g, unknown or other
  misc_feature (463)..(463): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctggtggganacagcgtcaccatcacttgccggnagtcagtccattaacactattaaatgtatcaaacaaaacaggaaacncccctaaatacctgtctatactgacatccactttgctaaaaggtcgggtacccagtacgaaggttccaaggtggacaggtggtatttaggggactagttttcatctacacaaatcagcagtctacgacttagaagtatttgactaaacttacgtacttagacaacagtactacgaatataccgagtacgttcganaacggacaggtagaagagtacaaaacgaactgtacggctagccaactcgtctcgtcttacaacttccttcccggactacgtactgg

SEQ ID NO: 324629 - DNA, 668 bp, Homo sapiens
  misc_feature: GZ8MTXP02I48N6.8.71.G05.1.454.CMB.2.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagctcgcgtgtccacgaccggtgctcgatttagtgtcgtcgcaagagagaggggggagtcagtctcagtcaggacacagcatggacatgagggtcccccgctcagctcctggggctcctgctcctctggctcgaggtgccagttgtgacatccagttgacccagtcctccctcctctctgtctgcttctggtggganacagcgtcaccatcacttcggccgggnagtcagtccaattaacaacttaattaatgtatacaaacaaaacgaggaacaccctaaatacctagtactatactgactatacctactttagacgtaaaggtcgggtacccagtacgtaagttacgagtggactaggtaggtagtttaggggacttacggttttccacttccgtacaacgtaactacagtctaacgttccgtaaccgtaaacgttaggtaaagttattttacggtacttaaacctttacctacgttagtaccaaaactagttaaacctaactaaataacgtaccggaacggttaccgggttacgtaacggaaacgggtaccgtaaggggtagaacgtaataaccgaaaacgtacttaggcgtacgtacgacctaaccgtacgttacgtacgttccgttactaccgttccctacccgtacctacgtacgtaacg

SEQ ID NO: 324630 - DNA, 520 bp, Homo sapiens
  misc_feature: GZ8MTXP02FXVB1.8.71.G05.1.454.CMB.2.raw
  modified_base (197)..(197): a, c, t, g, unknown or other
  misc_feature (197)..(197): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccggcgagtcagtccattaacaatatttaaattggtatcaacaaaaaccagggaaagcccctaaatacctggtctatactgcatccactttgcaaagtggggtacccatcaaaggttcagtggcagtggatttggggactagtttcactctcacaatcagcagtctcgaacctgaagattttgcaacttactactgtcaacagactacaatatacgaggacgtcggtcgaaggaccaaggtaggagatcgaaacgaactagtggactgacaccactctgtcttcacttctcccgccactctacg

SEQ ID NO: 324631 - DNA, 603 bp, Homo sapiens
  misc_feature: GZ8MTXP02JW7KH.8.71.G05.1.454.CMB.2.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (272)..(272): a, c, t, g, unknown or other
  misc_feature (272)..(272): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
tcagctcgcgtgtccacgaccggtgctcgatttagtgtcgtcgcaagagagaggggggagtcagtctcagtcaggacacaacatggacatgagggtccccgctcagctcctggggctcctgctcctctggctccgaggtgccagttgtgacatccagttgacccagtcctccctcctctctgtctgcttctgtggganacagcgtcaccatcacttggccgggnagtcagtccattaacaactatttaatgtatcaaacaaaacaggaaacncccctaaatacctggtacctatactgcatccactttgactaaaggtgggtacccatacgaaggttcagtgcagtggtacttgggactagtttcacgttctcaactaaatcctagctacgtctacggaacctgtaaacgtattttgactaacttacacgtntacaaganacttaaacataactacgtaggtacgttacgggtacgaaacgggtaccgtaaaggggtaggtaacgacgttaacgaaaacggacttaggacggtctacgaccacctaagttccgtggtttacctcgtaacttcccgtttacccacctattacccgtagaaccgg

SEQ ID NO: 324632 - DNA, 726 bp, Homo sapiens
  misc_feature: GZ8MTXP02I79PK.8.71.G05.1.454.CMB.2.raw
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgtcttctggtgganacngccgtcaccatcacgttgccggcagtcagtccattaacaactattaatgtatacaacaaaacaggaacaccctaaataccgtagtactatactgcactcctactttgacgtaaaggtcgggtaccctagtaccgtaaggttacaggtggacgtaggtacggtagtttacggggacttaggtttttaccaccttctacaaactaacgttcaacgtacgtacgttacccgttaccgtaaacccgttaggtaaaacgttacgttttacggaacccttaaaccgtttaacctaacgttacgttaaccaaaacgtaacgttaaaccttaaacctaaagttaccgtaaacccgtaagggtaacccggtttacggaaccggaaacgggtacccgtaaaggggtaaccggtaagtaacgttaaaccgaaaacgtaacgtacggtaacggtctaccgggacctaaccgtaacgttccttcgttaaccgtttacgaaacctttccccgtacccgtcttaaccgttcgtaaaccgg

SEQ ID NO: 324633 - DNA, 572 bp, Homo sapiens
  misc_feature: GZ8MTXP02HKV61.8.71.G05.1.454.CMB.2.raw
  modified_base (199)..(199): a, c, t, g, unknown or other
  misc_feature (199)..(199): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtctccctcctctctgtctgcttctggtggganacagcgtcaccatcacttgccgggcgagtcagtccattaacaactattaatgtatacaaacaaaacaggaaacaccctaaatacctgtactatactgcatccactttagacgtaaaggtcggggtacccatacgtaaggttcagtggacaggtggtagtttgggactagttttcacttctacactaatcagcagtcctacgaactagaagtatttgactaacttactactagtacaactagtacttaacaatactaccgaggtacgttacggacgaaacgggaccgaaggtacggaagaagtacgaaacgtaactaggtaggctacggacacgtactctagtcttcacttccctaccctcctactttaccagg

SEQ ID NO: 324634 - DNA, 785 bp, Homo sapiens
  misc_feature: GZ8MTXP02JQIF2.8.71.G05.1.454.CMB.2.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttcgaccctagtcctccctcctctctgtctgtcttctggtgganacagccgtcacctatcctacgttcggcccgggngtacgtcacgttaccctaagttaaacaacttaattaaattgtatacaaacaaaaccgagggaaacacccctaaataccgtaggtactaagtactcgactactcctaactttgacgtaaacggtccgggtaccctaacgttacgtaaacgttacgtaggtcgggtacgtagggttaggttaacggtttcggggtaacttaggttttaccgaacttcctaacctaaacgtactacgtaccgtactaacgtttacccaaaccggttaacccttaaaggtttaacgttaacgtttttacgaaacccttaaaaccttttaccgtactttaacggaacctaacgtaacgttaaaccttaagtaacgtaaaccgtaccgggtaacggttacgggttaccgtaacgaaacggtaaccgtaagggtacgtaggtaaactaaccgaaaacgtaacggtcggtacggtaacgttaccgacgttaaaccccgttacgttacccgttacggttaaccttacgtaacccgtttcccggtaaccctaccgttacgtacggtaaacg

SEQ ID NO: 324635 - DNA, 577 bp, Homo sapiens
  misc_feature: GZ8MTXP02FOARU.8.71.G05.1.454.CMB.2.raw
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
tcagctcgcgtgtccacgaccggtgctcgatttagtgtcgtcgcaagagagaggggggagtcagtctcagtcaggacacagcatggacatgagggtccccgctcagctcctggggcctcctgctcctctggctccgaggtgccagttgtgacatccagttgacccagtcctccctcctctctgtctgcttctggtgggagacagcgtcaccatccacttgccgggcagtcagtccaattaacatattaaatgtatacaaacaaaaccagggaaacacccctaaatacctggtctatactgcatcccactttgactaaagtcggggtacccatcgtaaaggttcagtggcagtggtagttgggactagtttcactcncacatcancacgtctacgaaacctgaaagtattttgactaacttactacttgacaaacgatacctaactaatacgtaacgtagggtaccggttcgtaacggacggtaacgaagggtacgaagtaactacgaaaacgtacgttagtcgactcgacacctagtcctacgttcctactacttccctacccactacctcgtaacg

SEQ ID NO: 324636 - DNA, 546 bp, Homo sapiens
  misc_feature: GZ8MTXP02FE3X2.8.71.G05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggnagtcagtccattaacaactatttaaattgtatcaaacaaaaaccagggaaacgacccctaaatacctggtctatactgcatccactttgacaaagtggggtacccatcgaaggttcagtggcagtggtattgggactagtttcactctacacaatcagcagtctaccgaacctgaaagtattttgactaacttactattgtcaaacagacttacaaatactacgaggacgttcgtacaaagggaccaaaggtggagaactacgaaaacgtaacgtagtcggactcgacaccgactctagtcttcactccttcccgccactctag

SEQ ID NO: 324637 - DNA, 637 bp, Homo sapiens
  misc_feature: GZ8MTXP02JWSE9.8.71.G05.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
tcagctcgcgtgtccacgaccggtgctcgatttagtgtcgtcgcaagagagaggggggagtcagtctcagtcaggacacagcatggacatgagggtcccccgctcagctcctggggctcctgctcctctggctccgaggtgccagttgtgacatccagttgacccagtcctccctcctctctgtctgcttctggtggganacagcgtcaccatcacttggccgggnacgtcagtcctaattaacaacttaattaattggtatacaaacaaaacgagggaaacgtacccctaaataccgtaggtactaactactgacactccctatttagacaaaggtcggggtacccatacgagttcgagtgacctagtagtagttggatagtttcacgtctacataactcagtcagtctacgtaacctgaagtatttagacctaacttaccacgtacgtacaacgtagtaacctaaacaactaacgtaccggtagggtacccgtttacggggaaccgtaaacggggtaacccaaaggggttggaaacgtataaaaccggaaaacgtaacgtcgggtaacggtactcggactaacggtactcctagttaaccttaccgaccttcctaccccgtacctatacccgtag

SEQ ID NO: 324638 - DNA, 641 bp, Homo sapiens
  misc_feature: GZ8MTXP02IPU1H.8.71.G05.1.454.CMB.2.raw
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
  modified_base (310)..(311): a, c, t, g, unknown or other
  misc_feature (310)..(311): n is a, c, g, or t
  modified_base (403)..(403): a, c, t, g, unknown or other
  misc_feature (403)..(403): n is a, c, g, or t
  modified_base (610)..(610): a, c, t, g, unknown or other
  misc_feature (610)..(610): n is a, c, g, or t
  modified_base (630)..(630): a, c, t, g, unknown or other
  misc_feature (630)..(630): n is a, c, g, or t
tcagctcgcgtgtccacgaccggtgctcgatttagtgtcgtcgcaagagagagggggggagtcagtctcagtcaggacacagcatggacatgagggtccccgctcagctcctggggcctcctgctcctctggctccgaggtgccagttgtgacatccagttcgacccagtcctcccctcctctctgtctgtcttcgtggtggganacagccgtacacctatcacgttcggccgggngagtcacgtacaattaacaattatttaatgtatacaaacaaaacgagggaacaccctaaatacctgtactatcnnctatcctagttacgactaaaggtcgggtaccctagtacgtaaggttcaggtggacgtaggtaggttaggtttagggtaacttgtttttaccncctctacacaaacgttcagtactagtaccgttaccgaacttaggtaacgttattttcgaaaccttaaacttaccttaagttactaacaaacgtacttaaacttaaccaaatacgtaacggtacggttacggttacggacgaaacgggacgtagggtaagaggtaactaacgaaacgtaacgtggagtctacgaccactactccgttntaaccttcgtacttctaccncctactactcg

SEQ ID NO: 324639 - DNA, 603 bp, Homo sapiens
  misc_feature: GZ8MTXP02H8UA2.8.71.G05.1.454.CMB.2.raw
  modified_base (403)..(403): a, c, t, g, unknown or other
  misc_feature (403)..(403): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctctctctgtctgctttctggtgggagacagcgtcaaccatcattggccgggcagtcagtccaattaaacaattaattaatggtatacaaacaaaaaccgagggaaacgacccctaaaatacctaggtactaataactgactactccaactttgacaaaaggtcggggtacccaagttacaaaggtttcaaggtggacaggtgtagtttggggactaggttttcatcctanaacatcaagcagtctacgacaggatatttgactaattacacgtntacactaanaacttaacaaataactaacgagtacgttcggtacgaaacgggacgaaaggtggaagtataacgaaaacgacgtagtacggacttggactaccctataccgtttacgtaaccttactaccttcccgttacccgacctacgtacgtacg

SEQ ID NO: 324640 - DNA, 734 bp, Homo sapiens
  misc_feature: GZ8MTXP02JDOEA.8.71.G05.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctggtggganacagcgtcaccatcacttgccggnagtcagtcataacactattaatgatacaaacaaaacagggaaacacccctaaatacctggtactatactgcactacctattgacgtaaaggtcgggtacccatacgtaaggtctaggtcggcaggtggtagttggggaacttggtttaccacgttctcgtaaactaactccgaagtaccgtacgttacccgtaaccgtaaacccgtaggttaaacgtagttttccgaacttaactttaactacgttacgtaacaaacgacgttaaaccttaacgaaattaacgtaacccggtaacgggttaaccggttacggtaaaccggtaaacggggtaaccccgtaaaggggttagggaacgttaacgtaaaccgtaaaaccggtaacgttacgggggtacgtaaccgtgggtaaacccctaaccccgtaagttcccggttaacgtttaaccctttaccggtaaccctttaccccggtttacccccggaacccgtttaacttacccggttaaacccgg

SEQ ID NO: 324641 - DNA, 734 bp, Homo sapiens
  misc_feature: GZ8MTXP02I91JN.8.71.G05.1.454.CMB.2.raw
  modified_base (228)..(228): a, c, t, g, unknown or other
  misc_feature (228)..(228): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtcctccctctctctgtctgcttctggtgggagacagccgtcacctatccacttggccgggngagtcagtccaattaacaacttatttaaattggtatacaacaaaaccaggaacacccctaaatacctggtactatactgactatccctactttacgacgtaaaaggttccggggtacccctaagttaccgtaaacggtttacgtaaggttcgggtacgtaaggggttcgggtaacgttttagggggtaaccgttacgtttttaacccgaccgtttccttacccaaacgttaaacttaccgaacggtacgtaacgggttaccctaacccgtaaaccttaggtaagttaacttttacgaacgttaaactttacctacttacgttaacaaacgtaactaacctttaaacaacgtttaacgaccggtaacgggttacgtttacccgggaactaaacggggaccgtaaggggtaacgaagtagtaaacgaaaacgtacgtggtaacggctagaccctacgtactcgttacgttcgttactaaccttcctaccgtccctactacgtaaccgg

SEQ ID NO: 324642 - DNA, 555 bp, Homo sapiens
  misc_feature: GZ8MTXP02II2UA.45.30.C08.1.454.CMB.2.raw
  modified_base (204)..(204): a, c, t, g, unknown or other
  misc_feature (204)..(204): n is a, c, g, or t
  modified_base (265)..(265): a, c, t, g, unknown or other
  misc_feature (265)..(265): n is a, c, g, or t
  modified_base (289)..(289): a, c, t, g, unknown or other
  misc_feature (289)..(289): n is a, c, g, or t
  modified_base (307)..(307): a, c, t, g, unknown or other
  misc_feature (307)..(307): n is a, c, g, or t
  modified_base (331)..(331): a, c, t, g, unknown or other
  misc_feature (331)..(331): n is a, c, g, or t
tcagacgcgatcgacacgaccggtgctcgatttagtctgacgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggganacagccaccctctcctgcagggccagtaggagtgtcagtaagtacttaggctggtaccaanagaaacctggcagctccagctccnatccatgatgcatccaanagggtccctggccgtcccagaccnggttccgtggccaggtgggtctggggacagagttccacttctcacccgtcagcaacgcctggacgcctgatgtattttgctagtttacttctgtcagtcagtcgttccgcaccgtccgctctacgtttcgggcgggggtacgacggggtggacggagtggacggaacggaaacgtggtacgggtctggccgtaccacttcgtcgtttcctttcacgtttccccg

SEQ ID NO: 324643 - DNA, 651 bp, Homo sapiens
  misc_feature: GZ8MTXP02GGPLP.45.30.C08.1.454.CMB.2.raw
  modified_base (203)..(203): a, c, t, g, unknown or other
  misc_feature (203)..(203): n is a, c, g, or t
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
tcagacgcgatcgacacgaccggtgctcgatttagtctgacgtcacgatctctcttggggaggaactgctcagttaggacccagagggaaccatggaagcccccagctcagcttctcttcctcctgctactctggctcccagataccaccggaaaattgtgttgacacagtctccaggcaccctgtctctgtctccagggganacacgccaccctctcctgcagggccagtaggagtgtcagtaagtacttaggctggtaccaanagaaacctggccaggctccgaggctccnatccatgatgcatccaagacggtccctggccgtcccagaccgtaggttccgtggacccgtagggtcgggtcgtaggggactagggtacgttccgaaccgttccgtaccgaccgttccaaggccctaacggcccgttagggaccgtcccgttaggaacttggttaacgtttttcggactttaaacggtttttccttacgttgttaccgtaacgtcgtaccggtccgttcccggacccgaccgcccgtcctacgtcggtttccgggggaccggggtaccgtaggggtcggagtcgtagacggtaacgacgtcggtacgcgtacggcaccgtagtccgtgttacctacgtactttcccccg

SEQ ID NO: 324644 - DNA, 567 bp, Homo sapiens
  misc_feature: GZ8MTXP01DHDCB.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtctgggggaggcttgggaaagccgtggggggtcccttagactctcctgtacagcctctggattcactttagtatgcctggatgacctgggtccgccaggctccaggaaggggctggaatgggttggccgtataaaagtgaaactgatggtgggacaacgagactaacgctgcacccgtgaaaggcagattcaccatctcaagagaatgattacaaacgaacaacgctactttactaacgaaaatgaatcagccctagaaaaccgaggacaccagccgtgtaattacgttgtaaccacgaaggggaagaaggcaaggttaatttaatgtaagttaggttaaggttgggtttaatttcg

SEQ ID NO: 324645 - DNA, 575 bp, Homo sapiens
  misc_feature: GZ8MTXP01BRWS2.38.55.E11.1.454.CMB.2.raw
  modified_base (426)..(426): a, c, t, g, unknown or other
  misc_feature (426)..(426): n is a, c, g, or t
  modified_base (519)..(519): a, c, t, g, unknown or other
  misc_feature (519)..(519): n is a, c, g, or t
  modified_base (536)..(536): a, c, t, g, unknown or other
  misc_feature (536)..(536): n is a, c, g, or t
  modified_base (539)..(539): a, c, t, g, unknown or other
  misc_feature (539)..(539): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagcgtggtatttccttgctgctatttaaaggtgtcagtgtgaggtgcagctggtggagtcgtgggggaggcgttgggaaagccgtggggggtcccttagactctcctgtacagcctctggattcacttttagtatgccttggatgacctgggtccgccaggctccgaggaaaggggctggaagttggggttgggccgttaagttaaaagtgaaactgagtggtggacaacgagactaacgctgcacccgtgaaacgcagattcacctatcctanaagagatagattacaaacgacacgtcttactttactaacgaaattgactacgagtcccaaggaaacccgaggactaccgagccgtgtaatacngtacccagaaggggaanagnttagttaatagtaagtagtagttagttcgttaatcg

SEQ ID NO: 324646 - DNA, 596 bp, Homo sapiens
  misc_feature: GZ8MTXP01AKBW6.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtctgggggaggcttgggaaagcctggggggtcccttagactctcctgtacagcctctggattcacttttagtatgcctggatgacctgggtccgccgaggctccgagggaaagggggctagggaagtggggttggaccgtaagttaaaaggtgaaaactggatgggtgggacaacgagactaaacgctgccacccgtgaaaggcagattcaccatctacaagagatagattacaaacggaacacgctctttacaactaaatgaatcagccctagaaaacccgaggaccacgacgtccgtgtaacttacgttcgtaaacccacggaagggaacgacggcttaaggtttaatagttaagaattaaggttaggtggtttaattaaccg

SEQ ID NO: 324647 - DNA, 438 bp, Homo sapiens
  misc_feature: GZ8MTXP01BBNHW.38.55.E11.1.454.CMB.2.raw
  modified_base (180)..(180): a, c, t, g, unknown or other
  misc_feature (180)..(180): n is a, c, g, or t
  modified_base (214)..(214): a, c, t, g, unknown or other
  misc_feature (214)..(214): n is a, c, g, or t
  modified_base (432)..(438): a, c, t, g, unknown or other
  misc_feature (432)..(438): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgnggacacagccgtgtattactgtaccacagggaanagcagttattatgatagtagtgttatctgtactactaggtatggacgtctggggccaagggaccacggtcattgtctccccagcctccaccaagggcccatcggtctcccctggcaccctcctccaagcgcacctctcgggggcacagcggccctgggctgcctggtcaaggactacttccacgtgatcgactgagcgggctgggcaaggcgcatagnnnnnnn

SEQ ID NO: 324648 - DNA, 446 bp, Homo sapiens
  misc_feature: GZ8MTXP01AS95A.38.55.E11.1.454.CMB.2.raw
  modified_base (181)..(181): a, c, t, g, unknown or other
  misc_feature (181)..(181): n is a, c, g, or t
  modified_base (215)..(215): a, c, t, g, unknown or other
  misc_feature (215)..(215): n is a, c, g, or t
  modified_base (405)..(405): a, c, t, g, unknown or other
  misc_feature (405)..(405): n is a, c, g, or t
  modified_base (437)..(438): a, c, t, g, unknown or other
  misc_feature (437)..(438): n is a, c, g, or t
  modified_base (440)..(446): a, c, t, g, unknown or other
  misc_feature (440)..(446): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctcttttctacaaatgatcagcctgaaaaccgnggacacagccgtgtattactgtaccacagggaanagcagttatatgatagtagtgttatctgtactactacggtatggacgtctggggccaagggaccacggtcattgtctccccagcctccaccaacgggcccatcggtcttccccctggccaccctcctccaagacgcacctctcgggggcacagccggccctgggctgcctggtcaggactactccacgtnatcgactgagcgggctggcaaggcgcagtagnngnnnnnnn

SEQ ID NO: 324649 - DNA, 531 bp, Homo sapiens
  misc_feature: GZ8MTXP01A8NWS.38.55.E11.1.454.CMB.2.raw
  modified_base (264)..(264): a, c, t, g, unknown or other
  misc_feature (264)..(264): n is a, c, g, or t
  modified_base (274)..(274): a, c, t, g, unknown or other
  misc_feature (274)..(274): n is a, c, g, or t
  modified_base (498)..(498): a, c, t, g, unknown or other
  misc_feature (498)..(498): n is a, c, g, or t
  modified_base (512)..(512): a, c, t, g, unknown or other
  misc_feature (512)..(512): n is a, c, g, or t
tcagtcgatcacgtcacgaccggtgctcgatttagcactcgcacgttgggtttgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattggagataattttgctcctggtaccagcagctcccaggaacagcccccaaacncctcatttangaccataataggcgaccctcaggattcctgaccgattctctggctccaagtctggcaccgtcagcccaccctggcatcaccggcctccagactggggacaggccgattatactgcggaacagtgggataccgagactgaatgcgttggggtgcgtcgggtgggagggccgaggcgtggcccgtccgtaggtcaacggcccgaaggtccttcgcccccgtggccncttctcgttccccnccctcctcacgtgcgtccg

SEQ ID NO: 324650 - DNA, 437 bp, Homo sapiens
  misc_feature: GZ8MTXP01DP04H.38.55.E11.1.454.CMB.2.raw
  modified_base (214)..(214): a, c, t, g, unknown or other
  misc_feature (214)..(214): n is a, c, g, or t
  modified_base (433)..(437): a, c, t, g, unknown or other
  misc_feature (433)..(437): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaanagcagttatatgatagtagtgttatctgtactactacggtatggacgtctggggccaagggaccacggtcattgtctccccagcctccaccaagggcccatcggtcttccccctggcaccctcctccaagacgcacctctcgggggcacgagcggccctgggctgcctggtcaaggactactcacgtgatcgactgagcgggctggcaaggcgcatagnnnnn

SEQ ID NO: 324651 - DNA, 575 bp, Homo sapiens
  misc_feature: GZ8MTXP01D3HFX.38.55.E11.1.454.CMB.2.raw
  modified_base (386)..(386): a, c, t, g, unknown or other
  misc_feature (386)..(386): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattggagattaattttgtctcctggtaccagcagctcccaggaacagcccccaaatcctcatttatgaccataataggcgaccctcaggattcctgaccgattctctggctccaagtctggcacgtcagccaccctggcatcaccgcctcagactggggacagccgattattacgngacgaacagtggactacgagactagaatgtcgggttgggtgtcgtcgggtggacgggaccgaggtcgtcggtacccgtccgtacggtcgaacgcccgaggtcccgttccggtcccccgttcggttccttccgttcccgttcccgttccccctaaccccgttccctaccgttaccggttcgaaccgtccg

SEQ ID NO: 324652 - DNA, 556 bp, Homo sapiens
  misc_feature: GZ8MTXP01DKEXC.38.55.E11.1.454.CMB.2.raw
  modified_base (307)..(307): a, c, t, g, unknown or other
  misc_feature (307)..(307): n is a, c, g, or t
  modified_base (375)..(375): a, c, t, g, unknown or other
  misc_feature (375)..(375): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcttgggaaagccgtggggggtcccttagactctcctgtacagcctctggattcacttttagtatgcctggatgacctgggtccnccaggctccaggaaaggggctggaatgggttggccgtaattaaaagtgaaactgatggtgggaacaanagactaacgctgcacccgtagaaaggcagatcaccatctacaagagatagattacaaacgaacacgcttctttacaacgaaatgatacagacctagaaaaccgaggacaacagccgtgtaattacttgtaaccacgaagggaagagcaagttaataagtgtatagttagttggttaactcg

SEQ ID NO: 324653 - DNA, 566 bp, Homo sapiens
  misc_feature: GZ8MTXP01CHX09.38.55.E11.1.454.CMB.2.raw
  modified_base (372)..(372): a, c, t, g, unknown or other
  misc_feature (372)..(372): n is a, c, g, or t
  modified_base (529)..(529): a, c, t, g, unknown or other
  misc_feature (529)..(529): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgagtgcagctggtggagtcgtgggggaggcgttgggaaagccgtggggggtcccttagactctcctgtacagcctctggattcacttttagtatgcctggatgacctggtccgcaggctccgaggaaaggggctggaagtgggtggaccgtaagttaaaagtgaaactgatcggtgganaacagactaacgctgcacccgtagaaagcagatcacatcacaagagatagattacaacgaacacgctactttactaacaaatgatacaagcctaagaaaaccgaaggacctaacgacgtccgtgtaacttacttcgtaaccaacgaagggaagaggnttaagttaataatgtaatagttagtcggttaataacg
